US009234205B2

(12) United States Patent
Hatzfeld

(10) Patent No.: US 9,234,205 B2
(45) Date of Patent: Jan. 12, 2016

(54) METHOD FOR INCREASING PLANT YIELD BY EXPRESSING A NUCLEIC ACID ENCODING AN ORNITHINE DECARBOXYLASE POLYPEPTIDE AND PLANTS EXPRESSING THE SAME

(75) Inventor: Yves Hatzfeld, Lille (FR)

(73) Assignee: BASF Plant Science GmbH, Ludwigshafen (DE)

( * ) Notice: Subject to any disclaimer, the term of this patent is extended or adjusted under 35 U.S.C. 154(b) by 308 days.

(21) Appl. No.: 12/988,190

(22) PCT Filed: Apr. 16, 2009

(86) PCT No.: PCT/EP2009/054484
§ 371 (c)(1), (2), (4) Date: Oct. 15, 2010

(87) PCT Pub. No.: WO2009/127671
PCT Pub. Date: Oct. 22, 2009

(65) Prior Publication Data

US 2011/0041210 A1 Feb. 17, 2011

Related U.S. Application Data

(60) Provisional application No. 61/084,402, filed on Jul. 29, 2008, provisional application No. 61/059,298, filed on Jun. 6, 2008, provisional application No. 61/058,237, filed on Jun. 3, 2008, provisional application No. 61/045,695, filed on Apr. 17, 2008, provisional application No. 61/151,520, filed on Feb. 11, 2009.

(51) Int. Cl.
*C12N 15/82* (2006.01)
*C12N 15/29* (2006.01)

(52) U.S. Cl.
CPC .................................. *C12N 15/8261* (2013.01)

(58) Field of Classification Search
None
See application file for complete search history.

(56) References Cited

U.S. PATENT DOCUMENTS

| | | | | |
|---|---|---|---|---|
| 6,504,083 | B1 * | 1/2003 | Barbour et al. | 800/278 |
| 2005/0108791 | A1 * | 5/2005 | Edgerton | 800/284 |

(Continued)

FOREIGN PATENT DOCUMENTS

| | | | |
|---|---|---|---|
| EP | 1586652 | A1 | 10/2005 |
| WO | WO-00/67558 | A1 | 11/2000 |
| WO | WO-2004/061122 | A2 | 7/2004 |

OTHER PUBLICATIONS

Bastola et al, Plant Physiol. 109:63-71, 1995.*
Waie et al (Plant Science, 16, pp. 727-734, 2003).*
Walden et al (Plant Physiology, 113, pp. 1009-1013, 1997).*
Klempnauer, K.-H. et al., "Nucleotide Sequence of the Retroviral Leukemia Gene *v-myb* and Its Cellular Progenitor *c-myb*: The Architecture of a Transduced Oncogene", Cell, 1982, vol. 31, pp. 453-463.
Sawhney, V. K., et al., "Gibberellins and Fruit Formation in Tomato: A Review", Scientia Horticulturae, 1984, vol. 22, pp. 1-8.

(Continued)

*Primary Examiner* — David T Fox
*Assistant Examiner* — Stephen Uyeno
(74) *Attorney, Agent, or Firm* — Drinker Biddle & Reath LLP

(57) ABSTRACT

Plants having enhanced yield-related traits and a method for making the same The present invention relates generally to the field of molecular biology and concerns a method for enhancing various yield-related traits by modulating expression in a plant of a nucleic acid encoding an Ornithine Decarboxylase (ODC) polypeptide. The present invention also concerns plants having modulated expression of a nucleic acid encoding an ODC polypeptide, which plants have enhanced yield-related traits relative to corresponding wild type plants or other control plants. The invention also provides constructs useful in the methods of the invention. In another embodiment, the present invention relates generally to the field of molecular biology and concerns a method for increasing various plant yield-related traits, by increasing expression in a plant of a nucleic acid sequence encoding a benzothiadiazole-induced homeodomain λ_(BIHD1) polypeptide. The present invention also concerns plants having increased expression of a nucleic acid sequence encoding a BIHD1 polypeptide, which plants have increased yield-related traits relative to control plants. The invention also provides constructs useful in the methods of the invention. In yet another embodiment, the present invention relates generally to the field of molecular biology and concerns a method for enhancing various yield-related traits by modulating expression in a plant of a nucleic acid encoding a MYB30. The present invention also concerns plants having modulated expression of a nucleic acid encoding a MYB30 polypeptide, which plants have enhanced yield-related traits relative to corresponding wild type plants or other control plants. The invention also provides constructs useful in the methods of the invention. In yet another embodiment, the present invention relates generally to the field of molecular biology and concerns a method for improving various plant growth characteristics by modulating expression in a plant of a nucleic acid encoding a THOM (tomato homeobox) protein. The present invention also concerns plants having modulated expression of a nucleic acid encoding a THOM polypeptide, which plants have improved growth characteristics relative to corresponding wild type plants or other control plants. The invention also provides constructs useful in the methods of the invention. In a further embodiment, the present invention relates generally to the field of molecular biology and concerns a method for increasing various plant yield-related traits, by increasing expression in a plant of a nucleic acid sequence encoding a benzothiadiazole-induced Jiomeodomain 2 (BIHD2) polypeptide. The present invention also concerns plants having increased expression of a nucleic acid sequence encoding a BIHD2 polypeptide, which plants have increased yield-related traits relative to control plants. The invention also provides constructs useful in the methods of the invention.

21 Claims, 67 Drawing Sheets

(56) References Cited

U.S. PATENT DOCUMENTS

2005/0150015 A1* 7/2005 Kasukabe et al. ............ 800/288
2006/0225154 A1 10/2006 Kasukabe et al.

OTHER PUBLICATIONS

Andersen, S. E., et al., "Metabolism of Polyamines in Transgenic Cells of Carrot Expressing a Mouse Ornithine Decarboxylase cDNA," Plant Physiol., 1998, vol. 116, pp. 299-307.

Bastola, D. R., et al., "Increased Putrescine Biosynthesis through Transfer of Mouse Ornithine Decarboxylase cDNA in Carrot Promotes Somatic Embryogenesis," Plant Physiol., 1995, vol. 109, pp. 63-71.

Cominelli, E., et al., "A Guard-Cell-Specific MYB Transcription Factor Regulates Stomatal Movements and Plant Drought Tolerance," Current Biology, 2005, vol. 15, pp. 1196-1200.

Li, S. F., et al., "Isolation of Two Novel *myb*-Like Genes from *Arabidopsis* and Studies on the DNA-Binding Properties of Their Products," The Plant Journal, 1995, vol. 8, No. 6, pp. 963-972.

Descenzo, R. A., et al., "Modulation of Cellular Polyamines in Tobacco by Transfer and Expression of Mouse Ornithine Decarboxylase cDNA," Plant Molecular Biology, 1993, vol. 22, pp. 113-127.

Gao, G., et al., "DRTF: a Database of Rice Transcription Factors," Bioinformatics, 2006, vol. 22, No. 10, pp. 1286-1287.

Hamill, J. D., et al., "Over-Expressing a Yeast Ornithine Decarboxylase Gene in Transgenic Roots of *Nicotiana rustica* can Lead to Enhanced Nicotine Accumulation," Plant Molecular Biology, 1990, vol. 15, pp. 27-38.

Jiang, C., et al., "Identification of Conserved Gene Structures and Carboxy-Terminal Motifs in the Myb Gene Family of *Arabidopsis* and *Oryza sativa* L. ssp. *indica*," Genome Biology, 2004, vol. 5, No. 7, p. R46.

Klempnauer, K.-H., et al., "The Product of the Retroviral Transforming Gene *v-myb* Is a Truncated Version of the Protein Encoded by the Cellular Oncogene *c-myb*," Cell, 1983, vol. 33, pp. 345-355.

Lee, J., et al., "Phylogenetic Diversity and the Structural Basis of Substrate Specificity in the β/α-Barrel Fold Basic Amino Acid Decarboxylases," Journal of Biological Chemistry, 2007, vol. 282, No. 37, pp. 27115-27125.

Lepri, O., et al., "Over-Expression of a cDNA for Human Ornithine Decarboxylase in Transgenic Rice Plants Alters the Polyamine Pool in a Tissue-Specific Manner," Mol. Genet. Genomics, 2001, vol. 266, pp. 303-312.

Luo, H., et al., "Overexpression in Transgenic Tobacco Reveals Different Roles for the Rice Homeodomain Gene *OsBIHD1* in Biotic and Abiotic Stress Responses," Journal of Experimental Botany, 2005, vol. 56, No. 420, pp. 2673-2682.

Luo, H., et al., "Up-Regulation of *OsBIHD1*, a Rice Gene Encoding BELL Homeodomain Transcriptional Factor, in Disease Resistance Responses," Plant Biol., 2005, vol. 7, pp. 459-468.

Manavella, P. A., et al., "Cross-Talk between Ethylene and Drought Signalling Pathways Is Mediated by the Sunflower Hahb-4 Transcription Factor," The Plant Journal, 2006, vol. 48, pp. 125-137.

Meijer, A. H., et al., "HD-Zip Proteins of Families I and II from Rice: Interactions and Functional Properties," Mol. Gen. Genet., 2000, vol. 263, pp. 12-21.

Meijer, A. H., et al., "Transcriptional Repression by Oshox1, a Novel Homeodomain Leucine Zipper Protein from Rice," The Plant Journal, 1997, vol. 11, No. 2, pp. 263-276.

Meiβner, R., et al., "Isolation and Characterization of the Tomato Homeobox Gene *THOM1*," Planta, 1995, vol. 195, pp. 541-547.

Minocha, R., et al., "A Rapid and Reliable Procedure for Extraction of Cellular Polyamines and Inorganic Ions from Plant Tissues," J. Plant Growth Regul., 1994, vol. 13, pp. 187-193.

Nölke, G., et al., "Immunomodulation of Polyamine Biosynthesis in Tobacco Plants Has a Significant Impact on Polyamine Levels and Generates a Dwarf Phenotype," Plant Biotechnology Journal, 2005, vol. 3, pp. 237-247.

Raffaele, S., et al., "A MYB Transcription Factor Regulates Very-Long-Chain Fatty Acid Biosynthesis for Activation of the Hypersensitive Cell Death Response in *Arabidopsis*," The Plant Cell, 2008, vol. 20, pp. 752-767.

Raffaele, S., et al., "An Essential Role for Salicylic Acid in AtMYB30-Mediated Control of the Hypersensitive Cell Death Program in Arabidopsis," FEBS Letters, 2006, vol. 580, pp. 3498-3504.

Reiser, L., et al., "The *BELL1* Gene Encodes a Homeodomain Protein Involved in Pattern Formation in the Arabidopsis Ovule Primordium," Cell, 1995, vol. 83, pp. 735-742.

Richardt, S., et al., "PlanTAPDB, a Phylogeny-Based Resource of Plant Transcription-Associated Proteins," Plant Physiology, 2007, vol. 143, pp. 1452-1466.

Riechmann, J. L., et al., "*Arabidopsis* Transcription Factors: Genome-Wide Comparative Analysis among Eukaryotes," Science, 2000, vol. 290, pp. 2105-2109.

Rosinski, J. A., et al., "Molecular Evolution of the Myb Family of Transcription Factors: Evidence for Polyphyletic Origin," J. Mol. Evol., 1998, vol. 46, pp. 74-83.

Sakakibara, K., et al., "Isolation of Homeodomain-Leucine Zipper Genes from the Moss *Physcomitrella patens* and the Evolution of Homeodomain-Leucine Zipper Genes in Land Plants," Mol. Biol. Evol., 2001, vol. 18, No. 4, pp. 491-502.

Sessa, G., et al., "DNA-Binding Specificity of the Homeodomain-Leucine Zipper Domain," J. Mol. Biol., 1997, vol. 274, pp. 303-309.

Sessa, G., et al., "Identification of Distinct Families of HD-Zip Proteins in *Arabidopsis thaliana*," in "Molecular-Genetic Analysis of Plant Development and Metabolism," vol. H81, Coruzzi G., et al., Eds., Springer, Berlin, pp. 411-426.

Sessa, G., et al., "The Athb-1 and -2 HD-Zip Domains Homodimerize Forming Complexes of Different DNA Binding Specificities," The EMBO Journal, 1993, vol. 12, No. 9, pp. 3507-3517.

Stracke, R., et al., "The *R2R3-MYB* Gene Family in *Arabidopsis thaliana*," Curr. Opin. in Plant Biol., 2001, vol. 4, No. 5, pp. 447-456.

Alabadí, D., et al., "Expression of Ornithine Decarboxylase Is Transiently Increased by Pollination, 2,4-Dichlorophenoxyacetic Acid, and Gibberellic Acid in Tomato Ovaries", Plant Physiol., 1998, vol. 118, No. 1, pp. 323-328.

* cited by examiner

Ornithine

Putrescine

```
A.thaliana_DAPCD_AT5G11880          --------------------------------------------------
C.reinhardtii_146886                --------------------------------------------------
A.variabilis_ADC_ABA23030           --------------------------------------------------
A.thaliana_ADC_AT4G34710            --------------------------------------------------
V.carteri_84542                     MRRYPIVTSLPPVRSPRLNRVIMTSSEVLSPPPPAAVASLAAPQLHSVDL
C.reinhardtii_XP_001697502          ----------------------MTTSEVLSPPPPSQVASLAQPQFNVEAL
C.reinhardtii_195696                ----------------------MTGAKDVVTLVPGATHAGAG--------
O.anatinus_XP_001513468             --------------------------------------------------
X.laevi_NP_001080167                --------------------------------------------------
P.tricornutum_12642                 --------------------------------------------------
S.pombe_CAB45689                    --------------------------------------------------
A.formosa_TA15389                   --------------------------------------------------
T.cacao_ABN04356                    --------------------------------------------------
S.lycopersicum_TA39775              --------------------------------------------------
S.tuberosum_TA25894                 --------------------------------------------------
D.stramonium_CAA61121               --------------------------------------------------
C.annuum_AAL83709                   --------------------------------------------------
N.tabacum_CDS4183                   --------------------------------------------------
N.benthamiana_BAF91874              --------------------------------------------------
N.glutinosa_AAG45222                --------------------------------------------------
G.max_CAD91350                      --------------------------------------------------
G.max_CAD91349                      --------------------------------------------------
L.japonicus_CAE02644                --------------------------------------------------
O.sativa_Os09g0543400               --------------------------------------------------
O.sativa_Os04g0136500               --------------------------------------------------
V.vinifera_GSVIVT00016806001        --------------------------------------------------
A.anophagefferens_27655             --------------------------------------------------
V.vulnificus_LODC_NP_762948         --------------------------------------------------
T.maritima_ODC_NP_229669            --------------------------------------------------
N.punctiforme_DAPDC_ZP_0011039      --------------------------------------------------
Synechocystis_CANSDC_BAA17602       --------------------------------------------------
```

FIGURE 2 A

```
A.thaliana_DAPCD_AT5G11880          ------------------------------MAAVTQFLSQPSSIRGTLNQ
C.reinhardtii_146886                --------------------------------------MQTISGRSVAGR
A.variabilis_ADC_ABA23030           ----------------------------MGVESTATSDEVVKVPANGNKL
A.thaliana_ADC_AT4G34710            ------------------------------MPALACVDTSFVPPAYAFSD
V.carteri_84542                     QSLQLPLVPDVVSVETGDVSAFTRSAWRNDTGKTGTYGLPTMLDMKAEAL
C.reinhardtii_XP_001697502          QAFSMPLVADVVNTENGDVASFARSSWHKESGKAGAFGLPTMLDMKAEAL
C.reinhardtii_195696                ---EAPFVR--TSFQNDMRTSFGRSSATDGPMKVDAAVPP----ALAAAV
O.anatinus_XP_001513468             --------------------------------------------------
X.laevi_NP_001080167                --------------------------------------------------
P.tricornutum_12642                 --------------------------------------------------
S.pombe_CAB45689                    --------------------------------------------------
A.formosa_TA15389                   --------------------------------------------------
T.cacao_ABN04356                    --------------------------------------------------
S.lycopersicum_TA39775              --------------------------------------------------
S.tuberosum_TA25894                 --------------------------------------------------
D.stramonium_CAA61121               --------------------------------------------------
C.annuum_AAL83709                   --------------------------------------------------
N.tabacum_CDS4183                   --------------------------------------------------
N.benthamiana_BAF91874              --------------------------------------------------
N.glutinosa_AAG45222                --------------------------------------------------
G.max_CAD91350                      --------------------------------------------------
G.max_CAD91349                      --------------------------------------------------
L.japonicus_CAE02644                --------------------------------------------------
O.sativa_Os09g0543400               --------------------------------------------------
O.sativa_Os04g0136500               --------------------------------------------------
V.vinifera_GSVIVT00016806001        ------------------------------------MHVLDIGGGFQESP
A.anophagefferens_27655             -----------------------------MLDVASKFSRSGESPRESPRS
V.vulnificus_LODC_NP_762948         --------------------------------------------------
T.maritima_ODC_NP_229669            --------------------------------------------------
N.punctiforme_DAPDC_ZP_0011039      --------------------------------------------------
Synechocystis_CANSDC_BAA17602       --------------------------------------------------
```

FIGURE 2 A (continued)

```
A.thaliana_DAPCD_AT5G11880       YQLNQTSLSRIPFLSLKSTLKPLKRLSVKAAVSQNSTKTLTKESASSFDH
C.reinhardtii_146886             STCSARVALRARKVCVTRAAATVEKHEEKAIG---SAWQFTQPAGKGLG-
A.variabilis_ADC_ABA23030        EGKNHKQKKLLPTNAPGDVSRAWKIEDSEALYRIEGWGQPYFSINAAGHV
A.thaliana_ADC_AT4G34710         TAGDVFIPASSPTSAAVVVDR-WSPSLSSSLYRIDGWGAPYFIANSSGNI
V.carteri_84542                  EMVQLDNWSVQPVDRGPATAAPDPKLLRSWQYQATGKLATAQVLVDLKAE
C.reinhardtii_XP_001697502       EQVQLDTWSAQPVDRGPAAAAPDPKLLRSWQYQATGKLATAQVLVDVKAE
C.reinhardtii_195696             QPIDRGPAAAASSLGPAASQELSRAMLSSWQYRVSGKAAVAELLQECAAE
O.anatinus_XP_001513468          -----------------------------MNNFSNDEFDFTFLDEGFTAK
X.laevi_NP_001080167             -----------------------------MNSFSNDDFDFSFLEEGFSAR
P.tricornutum_12642              --------------------------------------------------
S.pombe_CAB45689                 ---------MPAIMEKNMLVSESLRTTELLGHVKPIDSVVTWSSPGSSRQ
A.formosa_TA15389                ------------MGSIATSSKSLEAILK-----------APGVKNK----
T.cacao_ABN04356                 ------------MG---SSPRTLQAIVG-----------APGVRGK----
S.lycopersicum_TA39775           ----------MAGQTVIVSGLNPAAILQSTIGGAP---VAAAAENG-HTR
S.tuberosum_TA25894              ----------MAGQTVIVSGLNPAAILQSTIGGVP---VAAAAENG-HTR
D.stramonium_CAA61121            ----------MAGQTVIVSGLNPAAILQSTIGGAT---PAPAAEND-HTR
C.annuum_AAL83709                ----------MAGQTVIVSGLNPAAILQSTIGGAPPSTAAAAAENGDTTR
N.tabacum_CDS4183                ----------MAGQTIIVSGLNPAAILQSTIGGGASPTAAAAAENG--TR
N.benthamiana_BAF91874           ----------MAGQTIIVSGLNPAAILQSTIGGGAFPTAAAAAENG--TR
N.glutinosa_AAG45222             ----------MAGQTIIVSGLNPAAILQSTIGGGASPT-AAAAENG--TR
G.max_CAD91350                   ------------MPSLVAEAFEAK-GAEPLSLKPIFS--ASGVKGK----
G.max_CAD91349                   ------------MPSLVAEAFQAN-GAEPLNLKPIFC--ASGIKGK----
L.japonicus_CAE02644             ------------MPSLVSGEIQAKDAAESLSLNPIFS--ASGVKGK----
O.sativa_Os09g0543400            ----------------MVGGSPMQAVLM-----------APGVKDK----
O.sativa_Os04g0136500            ----------------MAGGRPLESVLV-----------APGVKGK----
V.vinifera_GSVIVT00016806001     TFHEIAAVIKEAINDYFPSSETSEDLKIMAEPGRFFAETAFTLVSNIIGK
A.anophagefferens_27655          SRPRSGSLSTVQADAWRTRDERLRCIAASWTARVEAEVAAVAARGGGGAP
V.vulnificus_LODC_NP_762948      ----------MAHSQSIFDIHSLTSP------------------------
T.maritima_ODC_NP_229669         --------------------------------------------------
N.punctiforme_DAPDC_ZP_0011039   ----------------MVSTHPTGVQHSGSQYLPQRRDTNPNLSPNQELL
Synechocystis_CANSDC_BAA17602    --------------------------------------------------
```

FIGURE 2 A (continued)

```
A.thaliana_DAPCD_AT5G11880         CFKKSSDG------------------------------------------
C.reinhardtii_146886               FYTGAEDG------------------------------------------
A.variabilis_ADC_ABA23030          TVSPKGDR---------------------------------------GGS
A.thaliana_ADC_AT4G34710           SVRPHGSET------------------------------------LPHQD
V.carteri_84542                    HIKSGGP-------------------------------------------
C.reinhardtii_XP_001697502         HIKAGGP-------------------------------------------
C.reinhardtii_195696               HIACGGP-------------------------------------------
O.anatinus_XP_001513468            DILDQKI-------------------------------------------
X.laevi_NP_001080167               DIVEQKI-------------------------------------------
P.tricornutum_12642                --------------------------------------------------
S.pombe_CAB45689                   AIGEAFK-------------------------------------------
A.formosa_TA15389                  EVIRLSN--------------GKS--------------------------
T.cacao_ABN04356                   KVAALSK--------------DGL--------------------------
S.lycopersicum_TA39775             KVVPLSK--------------DAL--------------------------
S.tuberosum_TA25894                KVVPLSK--------------DAL--------------------------
D.stramonium_CAA61121              KVVPLSR--------------DAL--------------------------
C.annuum_AAL83709                  KVVPLSK--------------DAL--------------------------
N.tabacum_CDS4183                  KVIPLSR--------------DAL--------------------------
N.benthamiana_BAF91874             KVIPLSR--------------DAL--------------------------
N.glutinosa_AAG45222               KVIPLSR--------------DAL--------------------------
G.max_CAD91350                     RVTALSA--------------EANA-------------------------
G.max_CAD91349                     RVTALSA--------------EKNG-------------------------
L.japonicus_CAE02644               RVTALTK--------------ECD--------------------------
O.sativa_Os09g0543400              KVLAFKRG-------------KGKD-------------------------
O.sativa_Os04g0136500              KVLAFKR--------------DGLK-------------------------
V.vinifera_GSVIVT00016806001       RVRGEKRE---------YWIDDGIYGSFNLPAYDKSSMMVKPLLGGSDRF
A.anophagefferens_27655            RIARGAWPGDWPSRAARPAAAAASRAAAAAAPPAPSPRGPPEARAVPNGR
V.vulnificus_LODC_NP_762948        --------------------------------------------------
T.maritima_ODC_NP_229669           --------------------------------------------------
N.punctiforme_DAPDC_ZP_0011039     PLTARVHN------------------------------------------
Synechocystis_CANSDC_BAA17602      --------------------------------------------------
```

FIGURE 2 A (continued)

```
A.thaliana_DAPCD_AT5G11880           ----FLYCEGTKVQDIMETVEKRPFYLYSKPQITRNLEAYKEALEGVRS-
C.reinhardtii_146886                 ----YLYCDQMRVEDIRNKVPESPFYLYSWNRIAHNYAEYKKALAGLDN-
A.variabilis_ADC_ABA23030            LDLFELVNALK-QRSLG-----LPLLIRFSDILEDRIERLNACFAKAIAR
A.thaliana_ADC_AT4G34710             IDLLKIVKKVTGPKSSGGLGLQLPLIVRFPDVLKNRLECLQSAFDYAIKS
V.carteri_84542                      ----MGMKQEAIKHIVKHKPD-DTFYVVDLANVQRMFKAWRAAMPRVMP-
C.reinhardtii_XP_001697502           ----MGMKQEAIKHILRHKPD-DTFYVVDLANVQRMFKAWRAAMPRVVP-
C.reinhardtii_195696                 ----RGVEEVAVRHIRRHDIDSDSIYVVDLASPFRLFKAWRAAMPRVLP-
O.anatinus_XP_001513468              ----NEVSSSD---------DKDAFYVADLGDVLKKHLRWYKALPRVTP-
X.laevi_NP_001080167                 ----NEVSLSD---------DKDAFYVADLGDIVKKHVRWFKALPRVTP-
P.tricornutum_12642                  ---------MP---------LEDSFYVVDIGVLVSQVYQWRRVFPRVEP-
S.pombe_CAB45689                     ----NTIEEIERAAVRGEPADSDAFFVADLNGVYRQLLRWHAKLPRVQP-
A.formosa_TA15389                    ----TDFIQSFISPN-QEV--RDPFYVLDLGMVSSLMDQWNSSIPSIRP-
T.cacao_ABN04356                     ----TAFIQSIVSTK-QEM--KEPFYVLDLGVVMALFDKWARNLPMAQP-
S.lycopersicum_TA39775               ----QDFMVSIITQKLQDD--KQPFYVLDLGEVVSLMEQWNSALPNIRP-
S.tuberosum_TA25894                  ----QDFMVSIITQKLQDD--KQPFYVLDLGEVVSLMEQWNSALPNIRP-
D.stramonium_CAA61121                ----QDFMVSIITQKLQDE--KQPFYVLDLGEVVSLMDQWNAGLPNIRP-
C.annuum_AAL83709                    ----QDFMVSIITQKLQGK--KKPFYVLDLGEVVSLMDQWNVALPNVHP-
N.tabacum_CDS4183                    ----QDFMLSIITQKLQDE--KQPFYVLDLGEVVSLMDQWKSALPNIRP-
N.benthamiana_BAF91874               ----QDFMLSIITQKLQDE--KQPFYVLDLGEVVSLMDQWKSALPNIRP-
N.glutinosa_AAG45222                 ----QDFMLSIITQKLQDE--KQPFYVLDLGEVVSLMDQWKSSLPNIRP-
G.max_CAD91350                       ---LTDFIQAIIADK-PDI--DSPFSVLDLGVVMGLMDKWACKLPTVQP-
G.max_CAD91349                       ---LTDFIQRIIADK-PDI--DTPFSVLDLGVVMGLMDQWACKLPTVQP-
L.japonicus_CAE02644                 ---MSHLIESIIADK-PDM--DSSFSVLDLGVVMELMDKWVTKFPTVQP-
O.sativa_Os09g0543400                ---ADAGVTALIRDIVAGG-ARSAFHVFDLAKVVDLHRGWRRALPDVRP-
O.sativa_Os04g0136500                ---KNEAVTGLIHDIVASSSARSAFHVLDLAKVVDLYAGWRRALPGVRP-
V.vinifera_GSVIVT00016806001         LGDQRDGFTALIRSISQKQKDREPFYILDLGAVVRLMDMWKQALPNVVP-
A.anophagefferens_27655              ACGLRDYCASVVAAAPRDY--AGPFYVVDVGAAERLYDAWAAALPRVRP-
V.vulnificus_LODC_NP_762948          ----VLSAEEIHLIEASVEQFGAPLLLLDCDVIRQQYRALKNALPNVTL-
T.maritima_ODC_NP_229669             --------MMEYWIRRALEVVKTPFLLFDLSVVEKKYLEMKAALKKADI-
N.punctiforme_DAPDC_ZP_0011039       ---HDSLEIGGCDVTTLVKQFGSPLYILDEETLRSACQQYRDAFKQYYK-
Synechocystis_CANSDC_BAA17602        ----MSSFAVNILENPRLSSLPSPCFVLEEELLQQNLAIFERLQQSAP--
                                                             .  :
```

FIGURE 2 A (continued)

```
A.thaliana_DAPCD_AT5G11880           -------VIGYAIKANNNLKILEHLRSLG----CGAVLVSGNELRLALLA
C.reinhardtii_146886                 -------LPCYAVKANNNLVIMKQLAAAG----AGAVLVSGNELKLAMKA
A.variabilis_ADC_ABA23030            YNYPGVYRGVFPVKCNQQRHLIEDLVRFGKPHQFGLEAGSKPELMIALAL
A.thaliana_ADC_AT4G34710             QGYDSHYQGVYPVKCNQDRFVVEDIVKFGSSFRFGLEAGSKPEILLAMSC
V.carteri_84542                      ---------YYAVKCNPEPGILKLLVAMG----AGFDCASKGELDMMLRM
C.reinhardtii_XP_001697502           ---------FYAVKCNPEPGILKLLNALG----AGFDCASKGELDMMLRM
C.reinhardtii_195696                 ---------YYAVKCYPEPAILKLLMALG----AGFDCASKGELDMMLKL
O.anatinus_XP_001513468              ---------FYAVKCNDSKAIVKTLAALG----AGFDCASKTEIQLVQSI
X.laevi_NP_001080167                 ---------FYAVKCNDGKAIVKTLSILG----AGFDCASKTEIQLVQSI
P.tricornutum_12642                  ---------FYAVKCNPDPLIVKTLATLG----CNFDCASRNEIRLVMEA
S.pombe_CAB45689                     ---------FYAVKCNPDPKVLALLNKFG----TGFDCASKGELEQILGL
A.formosa_TA15389                    ---------FYAVKCNHEPTLLAALAALG----VGFDCASQAEMEAVLAL
T.cacao_ABN04356                     ---------FYAVKCNPNPALLGALATLG----SGFDCASKAEIESVLSL
S.lycopersicum_TA39775               ---------FYAVKCNPEPSFLSMLSAMG----SNFDCASRAEIEYVLSH
S.tuberosum_TA25894                  ---------FYAVKCNPEPSFLSMLSAMG----SNFDCASRAEIEYVLSL
D.stramonium_CAA61121                ---------FYAVKCNPEPSFLSMLSAMG----SNFDCASRAEIEYVLSL
C.annuum_AAL83709                    ---------FYAVKCNPEPSFLSMLAAMG----SNFDCASRAEIEYVLSL
N.tabacum_CDS4183                    ---------FYAVKCNPEPSFLSILSAMG----SNFDCASRAEIEYVLSL
N.benthamiana_BAF91874               ---------FYAVKCNPEPSFLSILSAMG----SNFDCASRAEIEYVLSL
N.glutinosa_AAG45222                 ---------FYAVKCNPEPSFLSILSAMG----SNFDCASRAEIEYVLAL
G.max_CAD91350                       ---------FYAVKCNPNLSLIGALAALG----SSFDCASKAEIESVLSL
G.max_CAD91349                       ---------FYAVKCNPNLSLIGALAALG----SSFDCASKAEIESVLSL
L.japonicus_CAE02644                 ---------FYAVKCNPDISLIGALAALG----SSFDCASKAEIQIVLSL
O.sativa_Os09g0543400                ---------CYAVKCNPDGAMLAALAALG----AGFDCASRAEIEAVLAL
O.sativa_Os04g0136500                ---------FYAVKCNPDTALLGALAALG----AGFDCASRAEIEAVLAL
V.vinifera_GSVIVT00016806001         ---------YYAVKCNCQPPLITALASLG----ANFDCASRAEIETVMAL
A.anophagefferens_27655              ---------HYAVKCFPDAGLCRALAAKG----CGFDCASEAECRLVFAC
V.vulnificus_LODC_NP_762948          ---------HYALKPLPHPVVVRTLLAEG----ASFDLATTGEVELVASE
T.maritima_ODC_NP_229669             ---------YYAVKANSHPRIISLLARLG----SNFDVASKGEIEKLLAL
N.punctiforme_DAPDC_ZP_0011039       ----GESQVLYASKAWNCLAVCAIAASEG----LGIDVVSGGELYTALQA
Synechocystis_CANSDC_BAA17602        ---------IEVMLALKGFALFPCFPWLR----SGLAGASASSLWEARLA
                                                        .                 .      :   .
```

FIGURE 2 A (continued)

```
A.thaliana_DAPCD_AT5G11880          G---FDPTKCIFNGNGKSLEDLVLAAQEG-----VFVNVDSEFDLNNIVE
C.reinhardtii_146886                G---FDPKRTILNGNGKLPWELELAAEMG-----VNINIDSEFDLENIAA
A.variabilis_ADC_ABA23030           LD---TPGSLLVCNGYKDREYVETAMLSQRLGQTPIIVLEQVEEVDLVIA
A.thaliana_ADC_AT4G34710            LCK-GSPDAFLVCNGFKDAEYISLALLGRKLALNTVIVLEQEEELDLVIE
V.carteri_84542                     G---VSPSRIIFAHPCKRASDIRYARDHG-------IQYTTFDTVSELYK
C.reinhardtii_XP_001697502          G---VSPNRIIFAHPCKRASDIRYAREHN-------VQYTTFDTVSELHK
C.reinhardtii_195696                G---VSPGRIIFAHPCKRGADFRYAREHG-------ITYTTFDSSSELHK
O.anatinus_XP_001513468             G---VSPERIIYANPCKQVSQIKYAANSG-------VQMMTFDSEVELMK
X.laevi_NP_001080167                G---VSPERIIYANPCKQVSQIKYAASCG-------VEKMTFDSEVELMK
P.tricornutum_12642                 TKDMPTKPDIIYANPCKSRLGLLEAVCKG-------VKMVTFDNEMEVQK
S.pombe_CAB45689                    G---VSPDRIVYANPCKAITYVRYAASKG-------INLMTFDNADELYK
A.formosa_TA15389                   G---VSADQIVFANPCKAETHIKFAASVG-------VNLTTYDSPYEIEK
T.cacao_ABN04356                    G---VSPGRIIFANPCKAESHIKYAATVG-------VNLTTFDSKEELEK
S.lycopersicum_TA39775              G---ISPDRIVFANPCKPESDIIFAEKIG-------VNLTTYDSEDEVYK
S.tuberosum_TA25894                 G---ISPDRIVFANPCKPESDIIFAEKIG-------VNLTTYDSEDEVYK
D.stramonium_CAA61121               G---ISPDRIVFANPCKPESDIIFAAKVG-------VNLTTFDSEDEVYK
C.annuum_AAL83709                   G---ISPERIVFANPCKPESDIIFAEKVG-------VNLTTYDSEDEVYK
N.tabacum_CDS4183                   G---ISPDRIVFANPCKPESDIIFAAKVG-------VNLTTYDSEDEVYK
N.benthamiana_BAF91874              G---ISPDRIVFANPCKPESDIIFAAKVG-------VNLTTYDSEDEVYK
N.glutinosa_AAG45222                G---ISPDRIVFANPCKPESDIIFAAKVG-------VNLTTYDSEDEVYK
G.max_CAD91350                      G---VSPDRIIYANPCKSESHIRYAASVG-------VNVTTYDSLDEVEK
G.max_CAD91349                      G---VSPDRIIYANPCKSESHIRYAASVG-------VNVTTYDSIDEVEK
L.japonicus_CAE02644                G---ISPDRIVYANPCKSESDIKYAATVG-------VNLATYDSVYEVDK
O.sativa_Os09g0543400               G---VRPATIVYANPCKPEAHLEYAAEVG-------VNLTTYDSEEEVAK
O.sativa_Os04g0136500               G---VPPAAIVYANPCKPGAHVAFAAEAG-------VNVTTYDSEEEVAK
V.vinifera_GSVIVT00016806001        G---VGAQQIVYANPCKGESHLKYAASVG-------VNLTTFDSMQEIDK
A.anophagefferens_27655             G---ATPRDVVFANPCKRPSDVNFLAASG-------VPWTTFDCCDELAK
V.vulnificus_LODC_NP_762948         G---VPADLTIHTHPIKRDADIRDALAYG-------CNVFVVDNLNELEK
T.maritima_ODC_NP_229669            G---VDGKRMSFGNTIKREEDIAFAYKNG-------IRLFAVDSEMEVEK
N.punctiforme_DAPDC_ZP_0011039      G---VSPEKIYLHGNNKSREELILAIESG-----VTIVADNWYELRTLVE
Synechocystis_CANSDC_BAA17602       A-EEFGKEVHVYAPTYRPDDLPAIIPLAS---------HITFNSLGQWHR
                                                               :
```

FIGURE 2 A (continued)

```
A.thaliana_DAPCD_AT5G11880          ASRISGK-QVNVLLRINPDVDPQVHPYVATGNKNSKFGIRNEKLQWFLDE
C.reinhardtii_146886                AARKTGK-KVSVLLRINPDVDPQVHSYVSTGLASSKFGIRNSHIKWFLDE
A.variabilis_ADC_ABA23030           ASHQLGI-KPILGVRAKLS-TQGMGRWGTSTGDRAKFGLTIPEIIQAVDK
A.thaliana_ADC_AT4G34710            LSQKMNV-RPVIGLRAKLR-TKHSGHFGSTSGEKGKFGLTTTQIVRVVRK
V.carteri_84542                     ISQMNP--DFKCVLRIRA---DDPDARVPLG---LKYGAEVSEAPVLLQT
C.reinhardtii_XP_001697502          IAQMNP--DFKCVLRIRA---DDPDARVPLG---LKYGAEVSEADVLLRT
C.reinhardtii_195696                IAEMDP--EFKCVLRIRA---DDPGARVPLG---LKYGAEVEEAAGLLAE
O.anatinus_XP_001513468             VNRAHP--KAKLVLRIAT---DDSKAVCRLS---VKFGATLKTSRLLLER
X.laevi_NP_001080167                VARNHP--NAKLVLRIAT---DDSKAVCRLS---VKFGATLKTSRLLLER
P.tricornutum_12642                 CASISK--NIQLVLRIIT---DDRGSQCRLS---SKFGAPRHKWRLLLAA
S.pombe_CAB45689                    VKQHHP--NSRLLLRIST---DDSNSLCRLS---LKFGASLDDTGKLLDI
A.formosa_TA15389                   MKKWHP--KCALLLRIKA--GDDGNARCPLG---PKYGALPEEVTQLLQA
T.cacao_ABN04356                    IKKWHP--KCALLIRVKA--PDDGGARCPLG---PKYGALPEEVTPLLQA
S.lycopersicum_TA39775              IRKHHP--KCELLLRIKP--MTDGNARCPMG---PKYGALPEEIEPLLRT
S.tuberosum_TA25894                 IRKHHP--KCELLLRIKP--MNDGNARCPMG---PKYGALPEEIEPLLRT
D.stramonium_CAA61121               IRKHHP--KCELLLRIKP--MDDGNARCPMG---PKYGALPEEVEPLLRT
C.annuum_AAL83709                   IKKHHP--KCELLLRIKP--MNDGNARCPMG---PKYGALPEEIEPLLRI
N.tabacum_CDS4183                   IRKHHP--KSELLLRIKP--MLDGNARCPMG---PKYGALPEEVDPLLRA
N.benthamiana_BAF91874              IRKHHP--KSELLLRIKP--MLDGNARCPMG---PKYGALPEEVDPLLRA
N.glutinosa_AAG45222                IRKHHP--KSELLPRIKP--MFDGNARCPMG---PKYGALPEEVEPLLRA
G.max_CAD91350                      IRNCHP--TCELLLRIKP--PQDSGARTSLG---LKYGALPEEVHELLQA
G.max_CAD91349                      IRKCHP--TCELLLRIKP--PQDSGARTSLG---LKYGALPEEVDELLQA
L.japonicus_CAE02644                VQKWHP--KCELLLRIKY--DSE-GALASLG---VKYGALPEEVPELLKA
O.sativa_Os09g0543400               VRRCHP--RCELLLRIKA--PDSGDAKVDLG---LKYGANPDEVLPLLRA
O.sativa_Os04g0136500               VKRCHP--SCELLLRIKA--PDCGGVKVDLG---LKYGANPDEVLPLLRA
V.vinifera_GSVIVT00016806001        IIMWHK--KCDLLLRIKAP-NDEKGSWRSLG---SKFGALREEVVPLLQH
A.anophagefferens_27655             LAGLLPG-ATRAVLRLRC---DDPTSRLPFG---PKYGALEDEVPGLLAA
V.vulnificus_LODC_NP_762948         FKAYRD--DVELLVRLSF---RNSEAFADLS---KKFGCSPEQALVIIET
T.maritima_ODC_NP_229669            VAINAP--GSFVFVRVET---DGADADWPLS---RKFGTNPEHALQLLSY
N.punctiforme_DAPDC_ZP_0011039      IAQPGQ--SIRIMLRLTPGIECHTHEYIRTGHLDSKFGFDPNDLDEVFTF
Synechocystis_CANSDC_BAA17602       YRESLKNTAVKAGLRINP-----EYSPVQTD----LYNPCVSGSRLGVQA
                                                  *                     :.         .
```

FIGURE 2 A (continued)

```
A.thaliana_DAPCD_AT5G11880        VKAHPKELKLVGAHCHLGSTITKVDIFRDAAVLMIEYIDEIRRQGFE-VS
C.reinhardtii_146886              IRKEP-LLELVGVHSHLGSTITKVNIFRDAAVIMCDFVKMIRAEGFQ-LK
A.variabilis_ADC_ABA23030         LRDADLLDSLQLMHFHIGSQISAINVIKDAIQEASRIYVELASLGAN-MK
A.thaliana_ADC_AT4G34710          LRQSGMLDCLQLLHFHIGSQIPSTSLLSDGVAEAAQLYCELVRLGAH-MK
V.carteri_84542                   AKDLGLH--VVGVSFHVGSACQNLSTFSGAIENARKVFDEAHTLGFH-ME
C.reinhardtii_XP_001697502        AKELGLQ--VVGVSFHVGSACQNLSTFSGAIENARKVFDEAGALGFN-ME
C.reinhardtii_195696              AKQLGLE--VVGVSFHVGSAAKNLATFTNAIANARKVFDDAAGMGFK-ME
O.anatinus_XP_001513468           AKELNID--VIGVSFHVGSGCTDPDTFVQAVTDARCVFDMGAELGFD-MY
X.laevi_NP_001080167              AKELNVD--IIGVSFHVGSGCTDPQTYVQAVSDARCVFDMGAELGFN-MH
P.tricornutum_12642               AQKHGLQ--VVGVSFHVGSGCRDASRYEAALKDAREIFDLAGEYGMN-MQ
S.pombe_CAB45689                  AKSLELN--VVGVSFHVGSGSYDPSAFLDAIQRSRQVFDQGLERGFN-FD
A.formosa_TA15389                 AHAAGLP--VVGVSFHVGSATTYSLAYRSAIAAAKEVFNTALQLGMPRMR
T.cacao_ABN04356                  AQTARLT--VTGVSFHIGSGAMQFRAYREAIAAAKTVFETAARLGMPKMH
S.lycopersicum_TA39775            AQAARLT--VSGVSFHIGSGDADSNAYLGAIAAAKQVFETAAQLGMPKMT
S.tuberosum_TA25894               AQAARLT--VSGVSFHIGSGDADSNAYLGAIAAAKHVFETATQLGMPKMT
D.stramonium_CAA61121             AQAARLT--VSGVSFHIGSGDADSKAYLGAIAAAKGVFETAARFGMSKMT
C.annuum_AAL83709                 AQASRLT--VSGVSFHIGSGDADSNAYLGAIAAAKQVFETAAKFGMSKMN
N.tabacum_CDS4183                 AQAARLT--VSGVSFHIGSGDADSNAYLGAIAAAKEVFETAAKLGMSKMT
N.benthamiana_BAF91874            AQTARLT--VSGVSFHIGSGDADSNAYLGAIAAAKEVFETAAKLGMSKMT
N.glutinosa_AAG45222              AQAARLT--VSGVSFHIGSGDADSNAYLGAIAAAKEVFETAAKLGMSKMT
G.max_CAD91350                    AHEAGLK--VTGVSFHIGSGGADTRAYDGAISAAKNVFEMASGLGLPRMR
G.max_CAD91349                    AHEAGLK--VTGVSFHIGSGGADTRAYHGAISAAKNVFESASRLGLPRMG
L.japonicus_CAE02644              AEAAGVN--VTGVSFHIGSGGADPLALSGAIEAAKSVFEMASHFGMSRMS
O.sativa_Os09g0543400             AQREGVA--VAGVSFHVGSGASRADVYRGAIEAAREAFDAAAALGMPPMR
O.sativa_Os04g0136500             ARRAGLG--VAGVSFHVGSGASRAAVYRGAIEAARAAFDAAAGLGMPPMR
V.vinifera_GSVIVT00016806001      ANAAGLR--VIGVSFHVGSKVNDPQVYRGAIASARGVFDAAAQLKLPPMH
A.anophagefferens_27655           ARAAGVA--VAGVSFHVGSGARSPAAFAAAIAAARRAFDANAAAGGAPFD
V.vulnificus_LODC_NP_762948       AKEWNIR--IKGLSFHVGSQTTNPNKYVEAIHTCRHVMEQVVERGLPALS
T.maritima_ODC_NP_229669          ASKMKLI--PAGLSFHVGSQNLNPESWKKAIEIAGRVFKKAMRSGLN-LF
N.punctiforme_DAPDC_ZP_0011039    VSQQSTLD-CVGVHAHIGSQIFERQPHQDLAAVMVQWLRDAGKYGLN-IT
Synechocystis_CANSDC_BAA17602     AMLAGNLP--SGITGFLSHNLCESD--HLALEKTLGQIEKLFGEYLPQIE
                                                   .:.                        .
```

FIGURE 2 A (continued)

```
A.thaliana_DAPCD_AT5G11880        YLNIGGGLGIDYYHAG----------AVLPTPMDLINTVRELVL---SRD
C.reinhardtii_146886              YLNIGGGLGIDYSHQG----------QVLPTPTDLIDTVRDIVK---ELG
A.variabilis_ADC_ABA23030         YLDVGGGLGVDYDGSQTN-FYASKNYNMQNYANDIVAELKDTCAEKQIPV
A.thaliana_ADC_AT4G34710          VIDIGGGLGIDYDGSKSGESDLSVAYSLEEYAEAVVASVRVVCDRSSVKH
V.carteri_84542                   LLDIGGGFTGHFDEMGN-----VMFGEIANTINTALAAHFPP----EMG-
C.reinhardtii_XP_001697502        LLDIGGGFTGHFDEMGN-----VMFGEIANTINAALATNFPP----EMG-
C.reinhardtii_195696              LLDIGGGFTGHFDECGN-----VMFGEIANTINAALATYFPPGG--DLGD
O.anatinus_XP_001513468           LLDIGGGFPGSEDVK-------LKFEEITSVINPALEKYFPS-----DSG
X.laevi_NP_001080167              LLDIGGGFPGSEDVK-------LKFEEITSVINPALDKYFPA-----DSG
P.tricornutum_12642               VLDIGGGFPGETHRDGHF----MYFTEIAEQVAPLIDEMFP-------PS
S.pombe_CAB45689                  LLDIGGGFMND------------SFDGVADLIRSALDTYFD-------PS
A.formosa_TA15389                 TLNIGGGFFAGPHFE-----------EAAVTIKDALQLYFGN-----ETD
T.cacao_ABN04356                  VLNIGGGFTAGPQFA-----------EAASTVKAALQAYFPN-----EPS
S.lycopersicum_TA39775            VLDIGGGFTSGHQFT-----------TAAPAVKSALETHFHD-----FPE
S.tuberosum_TA25894               VLDIGGGFTSGHQFT-----------SAAPAVKSALETHFQN-----SPE
D.stramonium_CAA61121             VLDIGGGFTSGHQFT-----------TASAAVRSALEQHFHD-----EQE
C.annuum_AAL83709                 VLDIGGGFTSGHQFT-----------TAATAVKSALQQHFSN-----EPE
N.tabacum_CDS4183                 VLDVGGGFTSGHQFT-----------TAAVAVKSALKQHFDD-----EPE
N.benthamiana_BAF91874            VLDVGGGFTSGHQFT-----------TAAVAVKSALKQHFDD-----EPG
N.glutinosa_AAG45222              VLDVGGGFTSGHQFT-----------TAAVAVKSALKQHFDD-----EPE
G.max_CAD91350                    VLDIGGGFTSGPPFE-----------AAALKINAAIQASFGN-----EEG
G.max_CAD91349                    VLDIGGGFTSGPSFE-----------AAALKINAAIEGSFGK-----EEG
L.japonicus_CAE02644              ILDIGGGFTCGPELD-----------VAATKVKAAILAHFGD-----HQG
O.sativa_Os09g0543400             VLDIGGGFMAGRTFD-----------EAAAVINRALERHFGD-----LPC
O.sativa_Os04g0136500             VLNIGGGFVAGAAFG-----------DAAAVINRALGRYFGDL----LPT
V.vinifera_GSVIVT00016806001      VLDIGGGFQESPTFH-----------EIAAVIKEAINDYFPSSE--TSED
A.anophagefferens_27655           VLDIGGGFCGGFDASGTAAVSASGDATVAAAVNAALDLSFPAS---DFPG
V.vulnificus_LODC_NP_762948       TLDIGGGFPVNYTQQ---------VMPIDQFCAPINEALSLLPE--TVH-
T.maritima_ODC_NP_229669          LLNVGGGFPVQHTKP---------IPSMEEIGKAIEEAIDENLW--FVHN
N.punctiforme_DAPDC_ZP_0011039    ELNVGGGLGIKYTESDDP-------PSIEEWVKAICEVVQEACAVENLPL
Synechocystis_CANSDC_BAA17602     WLNLGGGHLMTSQGY------------DMDYAIAVIGEFHQR-----HPH
                                   :::***
```

FIGURE 2 A (continued)

```
A.thaliana_DAPCD_AT5G11880         LNLIIEPGRSLIANTCCFVNHVTGVK----------------TNGTK---
C.reinhardtii_146886               LTLVIEPGRSMVATGSALVNTVTGVK----------------TNGNK---
A.variabilis_ADC_ABA23030          PTLISESGRAIASHQSVLIFDVLSTSDVPRDNPEP-----PKEGESPVIN
A.thaliana_ADC_AT4G34710           PVICSESGRAIVSHHSVLIFEAVSADKPMVHQATPGDIQFLLEGNEEARA
V.carteri_84542                    VRVIAEPGRYFAETSSTLLTPVYGQR--------DRVAHDGAVKKD----
C.reinhardtii_XP_001697502         VRVIAEPGRYFAETSSTLLTPVYGQR--------DRVAADGSVKKD----
C.reinhardtii_195696               VRVIAEPGRYFAETSSTLMTVVIGQR--------DRPQKDGSTHKD----
O.anatinus_XP_001513468            VRIIAEPGRYYVASAFTLAVNIIAKKVVLK----EQTGSDDE-DDVNDKT
X.laevi_NP_001080167               VKIIAEPGRYYVASSFTLAVNIIAKKVMVN----EQSGSDDEEDAANDKT
P.tricornutum_12642                VRIIGEPGRYFVAACATLCCSVIAARTNEMNSSFEPEAIDDKEAAENLPP
S.pombe_CAB45689                   IRVISEPGRFFVSSSFTLAVNVIAKR-----------KLDDEEKVM----
A.formosa_TA15389                  LEVVSEPGRFFAETAFTLATCIIGK----------------RVRGEL---
T.cacao_ABN04356                   LTVIAEPGRFFAESAFTLATNIIGK----------------RVRGDL---
S.lycopersicum_TA39775             LTIIAEPGRFFAETAFTLATTIIGK----------------RVRGEL---
S.tuberosum_TA25894                LTIIAEPGRFFAETAFTLATTIIGK----------------RVRGEL---
D.stramonium_CAA61121              LTIIAEPGRFFAETAFTLATTIIGK----------------RVRGEL---
C.annuum_AAL83709                  LTIIAEPGRFFAETAFTLATTIIGK----------------RVRGDL---
N.tabacum_CDS4183                  LTIIAEPGRFFAETAFTLATTIIGK----------------RVRGEL---
N.benthamiana_BAF91874             LAIIAEPGRFFAETAFTLATTIIGK----------------RVRGEL---
N.glutinosa_AAG45222               LTIIAEPGRFFAETAFTLATTVIGK----------------RVRGEL---
G.max_CAD91350                     LVVIGEPGRYFAETAFTLATRIIGK----------------RVRGDV---
G.max_CAD91349                     LVVIGEPGRYFAETAFTLATRVIGK----------------RVRGDV---
L.japonicus_CAE02644               LVVIAEPGRYFTETAFTLVSRVIGK----------------RVRGEL---
O.sativa_Os09g0543400              VEVIGEPGRYFAETAFTLAARVIGK----------------RTRGEL---
O.sativa_Os04g0136500              VELIGEPGRYFAETAFTLAARVIGK----------------RRRGDV---
V.vinifera_GSVIVT00016806001       LKIMAEPGRFFAETAFTLVSNIIGK----------------RVRGEK---
A.anophagefferens_27655            LDVIAEPGRYFAEAAASLCCRVVGER--------------HRSRADVGAP
V.vulnificus_LODC_NP_762948        --VLAEPGRFICAPAVTSVASVMGQA---------------EREGQI---
T.maritima_ODC_NP_229669           LKVIAEPGRYMVGEAGWLVTKVLLKS---------------ERSGEK---
N.punctiforme_DAPDC_ZP_0011039     PKLLSEPGRSLIATACVTAYTVGSSK----------------VIPEIR--
Synechocystis_CANSDC_BAA17602      LRLIMEPGSAIAWQTGFLLSTVEDLI----------------ETPEFT--
                                     :  *.*
```

FIGURE 2 A (continued)

```
A.thaliana_DAPCD_AT5G11880          -----NFIVIDGSMAELIRPSLYDAYQHIELVSPTPPE------------
C.reinhardtii_146886                -----NFIVIDGSMATLIRPSLYGAYQHIELTKPHS--------------
A.variabilis_ADC_ABA23030           YLWETYQSINKENYQEFYHDATQFKEEAISRFNLGILRLRERAKAERLYW
A.thaliana_ADC_AT4G34710            NYEDLYAAVMRGDHESCLLYVDQLKQRCVEGFKEGVLSIEQLASVDGL--
V.carteri_84542                     ------YWLTDGLYGSFNCILYDGQSPAYKVVRSPLLPEPADIR------
C.reinhardtii_XP_001697502          ------YWLTDGLYGSFNCILYDGQNPGYKVVRSPLMADSTDSR------
C.reinhardtii_195696                ------YWLTDGLYGSFNCIVYDGQNPEWRIVRSPILPDPADAKT-----
O.anatinus_XP_001513468             IM----YYVNDGVYGSFNCILYDHAHVKPILQKRPKPDES----------
X.laevi_NP_001080167                LM----YYVNDGVYGSFNCILFDHAHVKPVLTKKPKPDEK----------
P.tricornutum_12642                 LQDDYSYYINDGVYGAFNNIMFDHATVRPRILG-PGEKIV----------
S.pombe_CAB45689                    ------YYVNDGVYGSLNCILFDHQHPVARVLKCGSRFVYNDLVGT----
A.formosa_TA15389                   ----REYWINDGLYGSMNCMLYDHATVTATPLACTSDPTNPKCNG-----
T.cacao_ABN04356                    ----REYWINDGIYGSMNCILYDHAVVTCMPLARASS---PRCKG-----
S.lycopersicum_TA39775              ----KEYWINDGLYGSMNCVLYDHATVTATPLACMSNRNNLNCGG-----
S.tuberosum_TA25894                 ----KEYWINDGLYGSMNCVLYDHATVTATPLACMSNRNNLNCGG-----
D.stramonium_CAA61121               ----REYWINDGLYGSMNCVLYDHATVNATPLACMSNRSNLNCGG-----
C.annuum_AAL83709                   ----REYWINDGLYGSMNCVLYDHATVTATPLACMSNRVNLNCSG-----
N.tabacum_CDS4183                   ----REYWINDGLYGSMNCVLYDHATVNATPLAVLSNRSNVTCGG-----
N.benthamiana_BAF91874              ----REYWINDGLYGSMNCVLYDHATVNATPLAVLSNRSNVTCGR-----
N.glutinosa_AAG45222                ----REYWINDGLYGSMNCVLYDHATVNATPLAVLSNRTNVTCGG-----
G.max_CAD91350                      ----REYWIDDGIYGTLNNIVFDYATVTCMPLACTSKPENPRCSRELN--
G.max_CAD91349                      ----REYWIDDGIYGTLNNIVFDYATVTCMPLACTSKPENPTCCRDLN--
L.japonicus_CAE02644                ----REYWINDGVYGSISNIIYDHATIRCAPLRQK----NLTC---VD--
O.sativa_Os09g0543400               ----REYWIDDGLYGSLNCILMDHYVPRPRPLAAAAAGEDTTAAT-----
O.sativa_Os04g0136500               ----REYWIDDGVYGSLNCILLDSYVPRPRPLAGARPGEE----------
V.vinifera_GSVIVT00016806001        ----REYWIDDGIYGSFNLPAYDKSSMMVKPLLGGSEWMN----------
A.anophagefferens_27655             PEPEAQYWITDGVYGAFNAIIYDGWLPHAVVVDDPRRAHGAGDAGGRG--
V.vulnificus_LODC_NP_762948         -----WYYLDDGIYGSFSGLMFDDARYPLTTIKQGGE-------------
T.maritima_ODC_NP_229669            -----WVYIDAGVFHGLAETIQNFEYEIRVLGKEREE-------------
N.punctiforme_DAPDC_ZP_0011039      ----TYVAIDGGMSDNPRPITYQSVYRAVVANKMSSP-------------
Synechocystis_CANSDC_BAA17602       -----HAMLDVSFTAHMPDCLEMPYRPEVRGARVPQTG------------
                                            :
```

FIGURE 2 A (continued)

```
A.thaliana_DAPCD_AT5G11880            --------------------------------------------------
C.reinhardtii_146886                  --------------------------------------------------
A.variabilis_ADC_ABA23030             ACCQKILDIIRQHDYVPDELEDLEKIMASIYYINLSVFQSAPDCWAIDQL
A.thaliana_ADC_AT4G34710              --CEWVLKAIGASDPV------------HTYNINLSVFTSIPDLWGIDQL
V.carteri_84542                       --------------------------------------------------
C.reinhardtii_XP_001697502            --------------------------------------------------
C.reinhardtii_195696                  --------------------------------------------------
O.anatinus_XP_001513468               --------------------------------------------------
X.laevi_NP_001080167                  --------------------------------------------------
P.tricornutum_12642                   --------------------------------------------------
S.pombe_CAB45689                      --------------------------------------------------
A.formosa_TA15389                     --------------------------------------------------
T.cacao_ABN04356                      --------------------------------------------------
S.lycopersicum_TA39775                --------------------------------------------------
S.tuberosum_TA25894                   --------------------------------------------------
D.stramonium_CAA61121                 --------------------------------------------------
C.annuum_AAL83709                     --------------------------------------------------
N.tabacum_CDS4183                     --------------------------------------------------
N.benthamiana_BAF91874                --------------------------------------------------
N.glutinosa_AAG45222                  --------------------------------------------------
G.max_CAD91350                        --------------------------------------------------
G.max_CAD91349                        --------------------------------------------------
L.japonicus_CAE02644                  --------------------------------------------------
O.sativa_Os09g0543400                 --------------------------------------------------
O.sativa_Os04g0136500                 --------------------------------------------------
V.vinifera_GSVIVT00016806001          --------------------------------------------------
A.anophagefferens_27655               --------------------------------------------------
V.vulnificus_LODC_NP_762948           --------------------------------------------------
T.maritima_ODC_NP_229669              --------------------------------------------------
N.punctiforme_DAPDC_ZP_0011039        --------------------------------------------------
Synechocystis_CANSDC_BAA17602         --------------------------------------------------
```

FIGURE 2 A (continued)

```
A.thaliana_DAPCD_AT5G11880          -----------AEVTKFDVVGPVCESADFLGKDRELPTPPQGAGLVVHDA
C.reinhardtii_146886                -----------TPVQTFDVVGPICESGDYLGKDRELATPSKGDGIVVHDA
A.variabilis_ADC_ABA23030           FPIMPIHRLDEEPTQRGILADLTCDSDGKIDRFIDLRDVKSVLELHPFQP
A.thaliana_ADC_AT4G34710            FPIVPIHKLDQRPGARGILSDLTCDSDGKINKFIGGESSLPLHELDKNGS
V.carteri_84542                     -------------TFTSTLWGPTCDSADCVYKDVQLP-VLRNGDWLMWNN
C.reinhardtii_XP_001697502          -------------TFLSTLWGPTCDSADCVYKDVTLP-VLRNGDWLMWNN
C.reinhardtii_195696                -------------TYVSTLWGPTCDSADVVYKDVALP-ELRNGDWLLWPN
O.anatinus_XP_001513468             -------------YYSCSIWGPTCDGLDRIVERCDMP-ELQVGDWMLFEN
X.laevi_NP_001080167                -------------FYSSSIWGPTCDGLDRIVERFELP-ELQVGDWMLFEN
P.tricornutum_12642                 -------------ATEEDVFGPTCDSIDVIARSVLLP-KLKVGDYMYFQN
S.pombe_CAB45689                    ------------GQHRCFIWGPTCDSLDVIANDAHLPYELNVGDWIYFED
A.formosa_TA15389                   -----------VKTYPSTVFGPTCDALDTILTDYQ-LPDLQVNDWLVFPN
T.cacao_ABN04356                    -----------ARTYDSTVFGPTCDALDTVLKVYP-LPELQVNDWLVFPN
S.lycopersicum_TA39775              -----------SKTFPSTVFGPTCDALDTVLRDYQ-LPELQVNDWLIFPN
S.tuberosum_TA25894                 -----------SKTFPSTVFGPTCDALDTVLRDYQ-LPELQVNDWLVFPN
D.stramonium_CAA61121               -----------SKTFPSTVFGPTCDALDTVLRDYQ-LPELQVNDWLIFPN
C.annuum_AAL83709                   -----------SKMFPSTIFGPTCDALDTVLRDYQ-LPELQVNDWLIFPN
N.tabacum_CDS4183                   -----------SKTFPTTVFGPTCDALDTVLRDYQ-LPELQVNDWLVFPN
N.benthamiana_BAF91874              -----------SKTFPTTVFGPTCDALDTVLRDYQ-LPELQVNDWLVFPN
N.glutinosa_AAG45222                -----------SKTFPTTVFGPTCDALDTVLRDYQ-LPELQVNDWLVFPN
G.max_CAD91350                      -----------LKTYPSTVFGPTCDSIDTVLRDYK-LPGLQVNDWLVFPN
G.max_CAD91349                      -----------LKTYPSTVFGPTCDSIDTVLRDYQ-LPELQVNDWLVFPN
L.japonicus_CAE02644                -----------AKTYPTTVFGPTCDCIDIVLKDYQ-LPELQVNDWLVFPN
O.sativa_Os09g0543400               -------------THASTVFGPTCDSLDTVVTGYQ-LPEMSVGDWLVFDD
O.sativa_Os04g0136500               -------------THASTVFGPTCDSIDTVVTGYQ-LPEMSVDDWLVFDD
V.vinifera_GSVIVT00016806001        -----------KAKFSSTVFGPTCDSMDMVVAESQ-LPELHMNDVLVFYN
A.anophagefferens_27655             -----------AGAALTTVFGPTCDSLDVVFSRVRNAPPLRRDDWLLFPC
V.vulnificus_LODC_NP_762948         -------------LIPSVLSGPTCDSVDVIAENILLPK-LNNGDLVIGRT
T.maritima_ODC_NP_229669            -------------LEEYHLAGPTCDSVDVIYDRIFLPKSITLNDLVCFIN
N.punctiforme_DAPDC_ZP_0011039      ------------VTQTVTIAGKHCESGDILIKNALLPKTEPGDILVVMGT
Synechocystis_CANSDC_BAA17602       -------------DTVYRLGGSSCLAGDFLG-DYAFDQPLQVGDRLIFED
                                                      : .  *   . :
```

FIGURE 2 A (continued)

```
A.thaliana_DAPCD_AT5G11880          -----------GAYCMSMASTYNLK----------------MRPPEYWVE
C.reinhardtii_146886                -----------GAYCMSMASNYNLK----------------MKPAEYMVE
A.variabilis_ADC_ABA23030           GEPYYMGMFLNGAYQEIMGNLHNLFGDTNAVHIQLT--PKGYQIEHVVKG
A.thaliana_ADC_AT4G34710            GGRYFLGMFLGGAYEEALGGVHNLFGGPSVVRVSQSDGPHSFAVTRAVPG
V.carteri_84542                     ----------AGAYTVAGACDFNGIE---------------FTTPGKLYV
C.reinhardtii_XP_001697502          ----------AGAYTVAGACDFNGIE---------------FTTPGKLYV
C.reinhardtii_195696                ----------AGAYTVAGACDFNGIE---------------FTTPMKVYV
O.anatinus_XP_001513468             ----------MGAYTVAAASTFNG-----------------FQRPTIYYV
X.laevi_NP_001080167                ----------MGAYTVAAASTFNG-----------------FQRPTLYYV
P.tricornutum_12642                 ----------MGAYTMAAASSFNG-----------------FTPSEKFYV
S.pombe_CAB45689                    ----------AGAYTVAAASCFNG-----------------FKTSRIVYL
A.formosa_TA15389                   ----------MGAYTACAGSKFNG-----------------FDTSAIPTY
T.cacao_ABN04356                    ----------MGAYTAAAGSNFNG-----------------FNTSAILTY
S.lycopersicum_TA39775              ----------MGAYTKAAGSNFNG-----------------FNTSAIVTH
S.tuberosum_TA25894                 ----------MGAYTKAAGSNFNG-----------------FNTSAIVTH
D.stramonium_CAA61121               ----------MGAYTKAAGSNFNG-----------------FNTSAIVTH
C.annuum_AAL83709                   ----------MGAYTKAAGSNFNG-----------------FNTSAIVTH
N.tabacum_CDS4183                   ----------MGAYTKAAGSNFNG-----------------FNTSAIVTH
N.benthamiana_BAF91874              ----------MGAYTKAAGSNFNG-----------------FNTSAIVTH
N.glutinosa_AAG45222                ----------MGAYTKAAGSNFNG-----------------FNTSTIVTH
G.max_CAD91350                      ----------MGAYTTSSGTNFNG-----------------FSSSAKSTF
G.max_CAD91349                      ----------MGAYTTSSGTNFNG-----------------FSSSAKSIF
L.japonicus_CAE02644                ----------MGAYTISSGTNFNG-----------------FTSAVKHVY
O.sativa_Os09g0543400               ----------MGAYTTAAGSNFNG-----------------FATSAIKIH
O.sativa_Os04g0136500               ----------MGAYTTAAGSSFNG-----------------FATSAINTY
V.vinifera_GSVIVT00016806001        ----------MGAYTASAGTRFNG-----------------FDISSISTF
A.anophagefferens_27655             ----------CGAYTSAGAADFNG-----------------IPATAAAGV
V.vulnificus_LODC_NP_762948         ----------MGAYTSATATDFNF-----------------FKRAQTIAL
T.maritima_ODC_NP_229669            ----------AGAYTVEYNTRFNG-----------------IEPPKMVFI
N.punctiforme_DAPDC_ZP_0011039      -----------GAYNYSMASNYNR-----------------LPRPAAVVV
Synechocystis_CANSDC_BAA17602       ----------MMHYTMVKTTTFNG-----------------VHHPAIGCL
                                                *       .*
```

FIGURE 2 A (continued)

```
A.thaliana_DAPCD_AT5G11880          EDGSITKIRHAETFDDHLRFFEGL--------------------------
C.reinhardtii_146886                -NGGLRKIRHEETLDQHLAVFEGL--------------------------
A.variabilis_ADC_ABA23030           DTMSEVVSYVQYDSEDMVENIRQRCERALEEKRITLAESQ---------R
A.thaliana_ADC_AT4G34710            QSSADVLRAMQHEPELMFQTLKHRAEEMMHTKGGSEGENEEEEEDDEFNN
V.carteri_84542                     WSDSAVD--VELAEENVMEA------------------------------
C.reinhardtii_XP_001697502          WSDSAVDAAEEGADEQVMNA------------------------------
C.reinhardtii_195696                WSDIAVDVEVPEADSKAEQAAEGAQ-------------------------
O.anatinus_XP_001513468             MSGPAWQRMQQINERGFPAEVEEPENNTLPLSCAWESGMEHHPATCASAS
X.laevi_NP_001080167                MSRPHWQLMHDIKEHGILPEV--PDLSALHVSCAQESGMELAPAVCTAAS
P.tricornutum_12642                 CSV-----------------------------------------------
S.pombe_CAB45689                    DTDILD--------------------------------------------
A.formosa_TA15389                   LACSDPCIGQENN-------------------------------------
T.cacao_ABN04356                    LAYSNPN-------------------------------------------
S.lycopersicum_TA39775              LAYAYPN-------------------------------------------
S.tuberosum_TA25894                 LAYAYPS-------------------------------------------
D.stramonium_CAA61121               LAYAYPS-------------------------------------------
C.annuum_AAL83709                   LAYAYPS-------------------------------------------
N.tabacum_CDS4183                   LAYSYPS-------------------------------------------
N.benthamiana_BAF91874              LAYSYPS-------------------------------------------
N.glutinosa_AAG45222                LAYTYPS-------------------------------------------
G.max_CAD91350                      LAYSSPEHSMF---------------------------------------
G.max_CAD91349                      LACSSPEHTMF---------------------------------------
L.japonicus_CAE02644                LACS--EQS-----------------------------------------
O.sativa_Os09g0543400               LAYSS---------------------------------------------
O.sativa_Os04g0136500               LAYSS---------------------------------------------
V.vinifera_GSVIVT00016806001        LTYVYRQY------------------------------------------
A.anophagefferens_27655             ETRYVRSDSMRCTADDDALGLLYSDKPPMEIIRYCD--------------
V.vulnificus_LODC_NP_762948         NEFVAS------SERMIG--------------------------------
T.maritima_ODC_NP_229669            EELTEISIEEKIKTRVLD--------------------------------
N.punctiforme_DAPDC_ZP_0011039      ANGEANLILQRETYQDLIRQDSLPERLKI---------------------
Synechocystis_CANSDC_BAA17602       RRSGEFELWRTFGYEDYRNRLG----------------------------
```

FIGURE 2 A (continued)

```
A.thaliana_DAPCD_AT5G11880        ------------------------------------------------
C.reinhardtii_146886              ------------------------------------------------
A.variabilis_ADC_ABA23030         LLQTYEQSLRRYTYLNS-------------------------------
A.thaliana_ADC_AT4G34710          VAASLDRSFHNMPYLATEQASPSNSLSAAISNLGFYYCDEDVYDYISA
V.carteri_84542                   ------------------------------------------------
C.reinhardtii_XP_001697502        ------------------------------------------------
C.reinhardtii_195696              ------------------------------------------------
O.anatinus_XP_001513468           INV---------------------------------------------
X.laevi_NP_001080167              INV---------------------------------------------
P.tricornutum_12642               ------------------------------------------------
S.pombe_CAB45689                  ------------------------------------------------
A.formosa_TA15389                 ------------------------------------------------
T.cacao_ABN04356                  ------------------------------------------------
S.lycopersicum_TA39775            ------------------------------------------------
S.tuberosum_TA25894               ------------------------------------------------
D.stramonium_CAA61121             ------------------------------------------------
C.annuum_AAL83709                 ------------------------------------------------
N.tabacum_CDS4183                 ------------------------------------------------
N.benthamiana_BAF91874            ------------------------------------------------
N.glutinosa_AAG45222              ------------------------------------------------
G.max_CAD91350                    ------------------------------------------------
G.max_CAD91349                    ------------------------------------------------
L.japonicus_CAE02644              ------------------------------------------------
O.sativa_Os09g0543400             ------------------------------------------------
O.sativa_Os04g0136500             ------------------------------------------------
V.vinifera_GSVIVT00016806001      ------------------------------------------------
A.anophagefferens_27655           ------------------------------------------------
V.vulnificus_LODC_NP_762948       ------------------------------------------------
T.maritima_ODC_NP_229669          ------------------------------------------------
N.punctiforme_DAPDC_ZP_0011039    ------------------------------------------------
Synechocystis_CANSDC_BAA17602     ------------------------------------------------
```

FIGURE 2 A (continued)

```
                              1                                                50
       Orysa_BIHD1     (1)    MATYYSS--PGNERDSQA-MYPADSG-NSSYPVPSALGN--MLYPGNGSS
     Zeama_BEL1 like   (1)    MATYYSS--PGSERDSQT-MYSAESG-NVSYPVPSALGN--FLYTNNASS
 Orysa_BEL1-like II    (1)    MATYYSS--PGSERDSQT-MYSRDPG-SASYPMSSALGN--MLYLNNPSS
       Gymco_BIHD1     (1)    MATYYPS--STNRRDIMANMYLRDTGGHSMYHEPADSDN--MVLLNYSS-
       Soltu_BEL30     (1)    MATYYPS--PNNQRDSDQTFQYFRQSLPESYSEASNAPENMLYEMNYSSS
     Vitvi_BEL1 like   (1)    MATYYPS--SNNQRDSAP-MYYLREPLPTSYSEVPVSPTNMLYMSYPSSS
     Medtr_BEL1 like   (1)    ---MYPN--QAFSSGSYAEMISGNTLLPHNYSESVGGQN---ELKFMTSM
        Arath_BHL1     (1)    MAATYHGNPPEISAGSDGGMQTLILMNPTSYVQYSQQDNDSNNNNNSNNS
        Arath_BHL6     (1)    ---------------------------MENYPETQFSPGDSLYQNAIVS-
         Consensus     (1)    MATYY S  P   RDS   MY        SY E S L N  MLY N  SS

                              51                                              100
       Orysa_BIHD1    (45)    GPYSEFSGIIQHQQNFMELPG--HPTAISQDSSSR-EPNLVASYIDQRSF
     Zeama_BEL1 like  (45)    GPYSEFSGIVQPQQNFMELTG--HPSAMSHDSSSNEASNLGASLTEQRSF
 Orysa_BEL1-like II   (45)    GPYSEFSGILQPQQNCMELPGPGHASAMSQDPSSR-ESDLLASHQGQRSF
       Gymco_BIHD1    (46)    GPYSEES-----QQNGMGFTD------------------LVASQIGENSF
       Soltu_BEL30    (49)    GAYSEMLTGTSQQQ-HNCLDIPSIGATPFNTSQQEILSNLGGSQIGIQDF
     Vitvi_BEL1 like  (48)    GSYSEXLGGNAQQHNHNCLEIPSVAASDSTQPQHEILSSLSGSHIVEHDF
     Medtr_BEL1 like  (43)    DDTMNMLSIDQGHSNATTSDPRTQFGLVESEQNVQCQGLSLALGTMMPSF
        Arath_BHL1    (51)    NNNNTNSNTNQNQSSFMFLDSHAPQPNASQQFVGIPLSGHEASSITAADN
        Arath_BHL6    (23)    --YSEESGGRERRTEANNLSAS------QERQALSRFGGLPQMQNIGQDF
         Consensus    (51)    G YSE SG  Q QQN M L         S        S L AS I   SF
```

FIGURE 6

```
                            101                                              150
Orysa_BIHD1          (92)   GPAKDMRNEMLMHL-----------MDGAHNAG-----ADLIHNDTHSSA
Zeama_BEL1 like      (93)   GPLKDMRNEMLMHL-----------MDGAHSSG-----SDLIHNDAHSTV
Orysa_BEL1-like II   (94)   SHVKDMKNEMLMHM-----------MDGAQGSG-----SELIHDDAHIGS
Gymco_BIHD1          (73)   SSWRDGRNEMLFMN-----------ENVGSMNGGDELLCNSVTGDPHMGI
Soltu_BEL30          (98)   SSWRDSRNEMLADN-------VFQVAQNVQGQG----LSLSIGSNIPSGI
Vitvi_BEL1 like      (98)   SAWRDGKNEMLLMNSLGGPASLLHTGQHLQAQG----LSLSIGTQIPSGI
Medtr_BEL1 like      (93)   QYQYPGNSFTSLMN-----------AQISNLKG----SASLKDDDAECMA
Arath_BHL1          (101)   ISVLHGYPPRLQYS-----------LYGAHQVDPTHQQAACETPRAQQGI
Arath_BHL6           (65)   GSWRDQASLRNGFN------------LMAAMAG-----ATGILQTAQG--
Consensus           (101)    S RD RNEMLM N              A   G     A  I  DA SGI

                            151                                              200
Orysa_BIHD1         (126)   QLEFGLLNNHNS------MSIAPAPGQGLSLSLNTHILAPSYPYWSAKTD
Zeama_BEL1 like     (127)   QLEFGLLNNHNS------TSIPLAPGQGLSLSLNTHILAPSYPHWSAKQD
Orysa_BEL1-like II  (128)   QLEFGVLNNHNS------SSIPSMQSQGLSLSLNTQIMAPSLPYWSIKPD
Gymco_BIHD1         (112)   QSQLGLLNGHNLSLQH--SNISNVQGQGLSLSLGSQIPIHPFKYQSAGSD
Soltu_BEL30         (137)   GLSHVQSNNPNQGGG-----FNMSFGDQDN----------SQPKEQRNAD
Vitvi_BEL1 like     (144)   QLPSIQYRNPNQGFTSFLSPTSSVSGEQGGRSG------SSRDEQLRNAD
Medtr_BEL1 like     (128)   SLSSGGFNNNVK----------RE---GLYN---------PHPSIGLNEG
Arath_BHL1          (140)   SLTLSSQNNQNQQHHQQHQPIHVGFGSQHG------------EDIRVGSG
Arath_BHL6           (96)   -LSLSLGSNILPG-------IHQISHQNGLP---------------RGND
Consensus           (151)   QL  GL NN N         I    GQGLS S        S P      D
```

FIGURE 6 (continued)

| | | 201 | | | | 250 |
|---|---|---|---|---|---|---|
| Orysa_BIHD1 | (170) | LLT HSYH | | | ----DNR NM | ----EA QA R S YL |
| Zeama_BEL1 like | (171) | LLT NSYQ | | | ----DNR NM | ----EA QA R S YL |
| Orysa_BEL1-like II | (172) | MLT QSYHDN | ----LRG DMR NL | | | ----EA RA R S YL |
| Gymco_BIHD1 | (160) | VSVLNSHHSSQGNCGTYRN | ESR FP | SIWSYGGTNIR TI P | | S YL |
| Soltu_BEL30 | (172) | YFP DNPGR | LDA GY | PYG----TSSI RT P | | S YL |
| Vitvi_BEL1 like | (188) | FLP GVLG | ----NQDS | SYG----MSSI RT PHS | | YL |
| Medtr_BEL1 like | (156) | QSD CLQGS | | | ----AVIPNNAL | SH YL |
| Arath_BHL1 | (178) | STGSGVTN | | | IAN VS S | YL |
| Arath_BHL6 | (123) | YATQSFPG | N | | LDVVRT P | S YL |
| Consensus | (201) | P G | D | MK QS | S I NSKYL | |
| **SKY BOX** | | | | | XXXX | |
| **PFAM POX PF07526** | | XXXXXXXXXXX | | | | |

| | | 251 | | | | 300 |
|---|---|---|---|---|---|---|
| Orysa_BIHD1 | (201) | K AQ LLDE VS W | | KAQKDQ QE | GKSDN A GGS GE | ---- |
| Zeama_BEL1 like | (202) | K AQ LLDE VS W | | KTDKGP QE | GKADG T G I E | ---- |
| Orysa_BEL1-like II | (207) | K AQ LLDE VS W C | | KAQKEK VE | GKADG T GP E | ---- |
| Gymco_BIHD1 | (210) | KTAQ LLDE V Q | | KKSDDNQ DNI | SKPTC N VES | ---- |
| Soltu_BEL30 | (208) | K AQ LLDE VS R | EQNSKK | ELTKDS S VDS NISSDT | | |
| Vitvi_BEL1 like | (224) | K AQ LLDE V R | | PDSEKN-QNIHELWKGS A V L NGTGMT | | |
| Medtr_BEL1 like | (178) | K AQ LLDE V RGL | | TGLEKQQ FHD GLDAS S GKST QSMQV | | |
| Arath_BHL1 | (197) | K AQ LLDE V ADSDDM | | AKSQLFS K-- | KGSCGN KPV ES AGAGG | |
| Arath_BHL6 | (148) | K AQ LLDEAV K | | FQAEGD-KN | NNPQEPNQ | ---- |
| Consensus | (251) | KAAQELLDEVVNV KALKQ | | S A | KE D G KS | |
| **SKY BOX** | | XXXXXXXXXXXX | | | | |
| **PFAM POX PF07526** | | XXXXXXXXXXXXXXXXXXXXXXXXXXXXXXXXXXXXXXXXXXXXXXX | | | | |

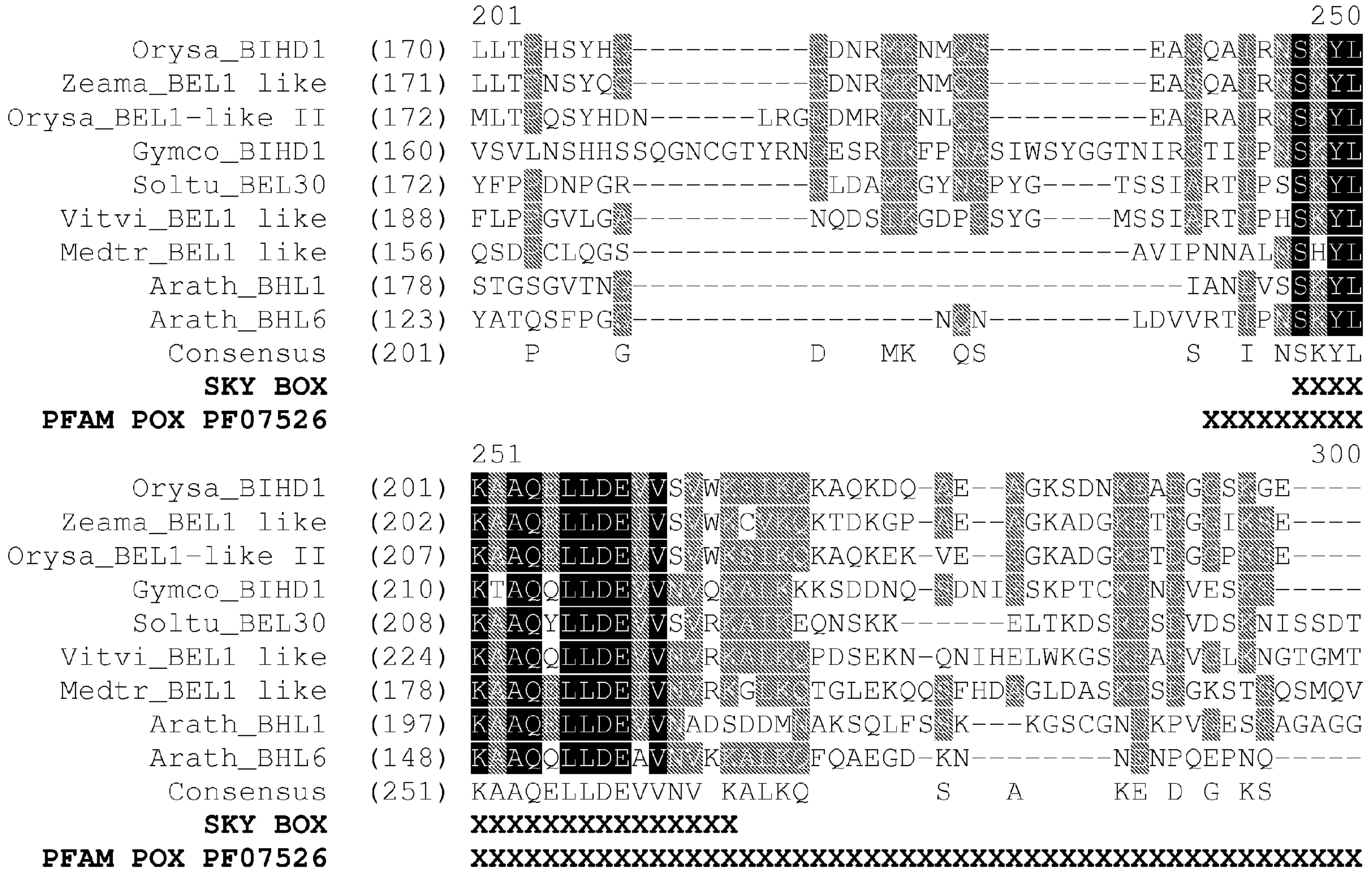

FIGURE 6 (continued)

HELIX 3 (cont'd)

| | | 501 — 550 |
|---|---|---|
| Orysa_BIHD1 | (437) | VRLWKPMVEEMYKEEIGEAELDSNSSSDNVPKSKDKIATSE-------KE |
| Zeama_BEL1 like | (438) | VRLWKPMVEEMYKEEIGEAELDSNSSSDNAQKNKDKAPSPS------NE |
| Orysa_BEL1-like II | (443) | VRLWKPMVEEMYKEEIGELEQDSNSSSDNAPKSKDKMASSE-------KE |
| Gymco_BIHD1 | (445) | VRLWKPMVEEMYKEEFGETELDSNSSSDNATKFRDELHSNSA------QE |
| Soltu_BEL30 | (447) | VRLWKPMVEEMYKEEAGEAKLDSNSSSDVAPKLATKDSKVS-RGELHQN |
| Vitvi_BEL1 like | (467) | VRLWKPMVEEMYKEEIGEAELDSNSSSDNAPKATKSDIRDSEERGDDFQP |
| Medtr_BEL1 like | (412) | VRLWKPMVEEMYKEEFGEAETSSNLLSDNTPKAPRDDDVRVWDDKREESH |
| Arath_BHL1 | (441) | VRLWKPMVEEMYMEEIKEQAKNMGSMEKTPLDQSNEDSADKSTSNQEKSP |
| Arath_BHL6 | (370) | VRLWKPMVEEMYKEEFTENESNS--SSDNTPKMSDIGPVDAE-------- |
| Consensus | (501) | VRLWKPMVEEMYKEEIGEAELDSNSSSDNAPK D SED |
| **Homeodomain** | | **XXXXXXX** |
| **PFAM homeobox PF00046** | | **XXXXX** |

| | | 551 — 600 |
|---|---|---|
| Orysa_BIHD1 | (481) | DLKSSMSQTYQPSQLGESKANIG--MMSLGGA----PAGFHNEGTQDDSF |
| Zeama_BEL1 like | (482) | DLQTPTSQACQTSQLGQSKAIVGGVMGFSGVL----AGGFHTEANPDDSF |
| Orysa_BEL1-like II | (487) | DLKNSRARICETSQLSESKTSIG--AMNVGGA----PVGFQNEPNPDDSF |
| Gymco_BIHD1 | (489) | DQRNSSTDKYHAKQS------------SY-------DPGYETEMPCAADG |
| Soltu_BEL30 | (496) | AASEF--EQYQSGQLLESKSNHEADVEMEGAS---------NAETQSQDG |
| Vitvi_BEL1 like | (517) | STTSTXTERCSTGRFLESKSSNGPDVEMGGPTXGASFRNGERGETQTDYG |
| Medtr_BEL1 like | (462) | DKLMNVDGAQQQGQLAGLKLDHGSSSTTELDRG---IQSSDHWTNVMDSR |
| Arath_BHL1 | (491) | MADTNYHMNPQHNGDLEGVTGMQGSPKRLRTSDETMMQPINAEFSSNDKL |
| Arath_BHL6 | (410) | ----DEDRAREFSQD------------------------------QTKPD |
| Consensus | (551) | D Q QL ESK G G E DS |

FIGURE 6 (continued)

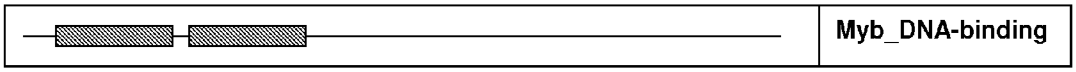

FIGURE 8

```
                                                 1                                                50
                                AT1G08810.1   (1) --------------------------------------------------
                                AT1G74650.1   (1) --------------------------------------------------
                                AT3G47600.1   (1) --------------------------------------------------
                                AT5G62470.1   (1) --------------------------------------------------
                          Poplar MYB30 orth   (1)
                                  At3g28910   (1)
                                AT3G28910.1   (1) --------------------------------------------------
                                    CDS3626   (1) --------------------------------------------------
LOC_Os03g26130.1_11973.m07957_protein_MYB   (1) --------------------------------------------------
LOC_Os07g43580.1_11977.m08585_protein_MYB   (1) --------------------------------------------------
                             LOC_Os08g33940   (1) MAGGGGSLAVGGGLNGWRGVSGSVGAAGLEEGSGPAWWRGHLIANGSRMK
LOC_Os08g33940.1_11978.m07384_protein_MYB   (1) MAGGGGSLAVGGGLNGWRGVSGSVGAAGLEEGSGPAWWRGHLIANGSRMK
LOC_Os09g24800.1_11979.m05634_protein_MYB   (1)
                             Zea MYB30 orth   (1)
LOC_Os11g03440.1_11981.m04539_protein_MYB   (1) --------------------------------------------------
LOC_Os12g03150.1_11982.m04313_protein_MYB   (1) --------------------------------------------------
                                  Consensus   (1)

                                                 51                                              100
                                AT1G08810.1   (1)                                                  M
                                AT1G74650.1   (1)                                                  M
                                AT3G47600.1   (1) -------------------------------------------------M
                                AT5G62470.1   (1) -------------------------------------------------M
                          Poplar MYB30 orth   (1) -------------------------------------------------M
                                  At3g28910   (1) -------------------------------------------------M
                                AT3G28910.1   (1) -------------------------------------------------M
                                    CDS3626   (1) -------------------------------------------------M
LOC_Os03g26130.1_11973.m07957_protein_MYB   (1)                                                  M
LOC_Os07g43580.1_11977.m08585_protein_MYB   (1) -------------------------------------------------M
                             LOC_Os08g33940  (51) KGGGSRRHAIPTGEAGSGAVSRVAVAVAVYVDSSIEQEQLEEVVPWWGLM
LOC_Os08g33940.1_11978.m07384_protein_MYB  (51) KGGGSRRHAIPTGEAGSGAVSRVAVAVAVYVDSSIEQEQLEEVVPWWGLM
LOC_Os09g24800.1_11979.m05634_protein_MYB   (1) -------------------------------------------------M
                             Zea MYB30 orth   (1) -------------------------------------------------M
LOC_Os11g03440.1_11981.m04539_protein_MYB   (1) -------------------------------------------------M
LOC_Os12g03150.1_11982.m04313_protein_MYB   (1) -------------------------------------------------M
                                  Consensus  (51)                                                  M

                                                 101                                             150
                                AT1G08810.1   (2) GRPPCCDKIGLKKGPWTPEEDIILVSYIQEHGPGNWRSVPTNIGLLRCSK
                                AT1G74650.1   (2) GRPPCCEKIEVKKGPWTPEEDIILVSYIQQHGPGNWRSVPANTGLLRCSK
                                AT3G47600.1   (2) GRPPCCDKIGVKKGPWTPEEDIILVSYIQEHGPGNWRSVPTHTGLRRCSK
                                AT5G62470.1   (2) GRPPCCEKIGVKKGPWTPEEDIILVSYIQEHGPGNWRSVPTHIGLR-CSK
                          Poplar MYB30 orth   (2) GRPPCCDKIGVKKGPWTPEEDIILVSYIQEHGPGNWRAVPTSIGLLRCSK
                                  At3g28910   (2) VRPPCCDKGGVKKGPWTPEEDIILVTYIQEHGPGNWRAVPTNIGLLRCSK
                                AT3G28910.1   (2) VRPPCCDKGGVKKGPWTPEEDIILVTYIQEHGPGNWRAVPTNIGLLRCSK
                                    CDS3626   (2) VRPPCCDKGGVKKGPWTPEEDIILVTYIQEHGPGNWRAVPTNIGLLRCSK
LOC_Os03g26130.1_11973.m07957_protein_MYB   (2) GRPPCCEKEGVKKGPWTPEEDMVLASYVQEHGPGNWRAVPPRTGLLRCSK
LOC_Os07g43580.1_11977.m08585_protein_MYB   (2) VRPPCCDKDGVKKGPWTPEEDLVLVSYVQEHGPGNWRAVPTRTGLMRCSK
                             LOC_Os08g33940 (101) GRPPCCVKAEVKKGPWTPEEDLMLVAYVQEHGPGNWRAVPTNIGLMRCSK
LOC_Os08g33940.1_11978.m07384_protein_MYB (101) GRPPCCVKAEVKKGPWTPEEDLMLVAYVQEHGPGNWRAVPTNIGLMRCSK
LOC_Os09g24800.1_11979.m05634_protein_MYB   (2) GRPPCCDKVGVKKGPWTPEEDLMLVSYIQEHGAGNWRAVPTNIGLMRCSK
                             Zea MYB30 orth   (2) GRPPCCDKMGVKKGPWTPEEDLMLVSYVQEHGPGNWRAVPTNIGLMRCSK
LOC_Os11g03440.1_11981.m04539_protein_MYB   (2) GRPPCCDKEGIKKGPWTPEEDIILVSYIQEHGPGNWRSVPINIGLMRCSK
LOC_Os12g03150.1_11982.m04313_protein_MYB   (2) GRPPCCDKEGIKKGPWTPEEDIILVSYIQEHGPGNWRSVPINIGLMRCSK
                                  Consensus (101) GRPPCCDK GVKKGPWTPEEDIILVSYIQEHGPGNWRAVPTNIGLLRCSK
```

FIGURE 9

```
                                                    151                                              200
                                 AT1G08810.1  (52)  SCRLRWTNYLRPGIKRGN-TPHEEGMIIHLQALLGNKWASIASYLPQRTD
                                 AT1G74650.1  (52)  SCRLRWTNYLRPGIKRGNFTQPEEKMIIHLQALLGNRWAAIASYLPQRTD
                                 AT3G47600.1  (52)  SCRLRWTNYLRPGIKRGNFTEHEEKMILHLQALLGNRWAAIASYLPERTD
                                 AT5G62470.1  (51)  SCRLRWTNYLRPGIKRGNFTEHEEKIIVHLQALLGNRWAAIASYLPERTD
                           Poplar MYB30 orth  (52)  SCRLRWTNYLRPGIKRGNFTDHEEKMIIHLQALLGNRWAAIASYLPQRTD
                                   At3g28910  (52)  SCRLRWTNYLRPGIKRGNFTEHEEKMIVHLQALLGNRWAAIASYLPQRTD
                                 AT3G28910.1  (52)  SCRLRWTNYLRPGIKRGNFTEHEEKMIVHLQALLGNRWAAIASYLPQRTD
                                     CDS3626  (52)  SCRLRWTNYLRPGIKRGNFTEHEEKMIVHLQALLGNRWAAIASYLPQRTD
LOC_Os03g26130.1_11973.m07957_protein_MYB     (52)  SCRLRWTNYLRPGIRRGG-SHEEERLLLHLQALLGNRWAAIASYLPHRTD
LOC Os07g43580.1 11977.m08585 protein MYB     (52)  SCRLRWTNYLRPGIKRGNFTDQEEKLIVHLQALLGNRWAAIASYLPERTD
                              LOC_Os08g33940 (151)  SCRLRWTNYLRPGIKRGNFTDQEEKLIVHLQALLGNRWAAIASYLPERTD
LOC Os08g33940.1 11978.m07384 protein MYB    (151)  SCRLRWTNYLRPGIKRGNFTDQEEKLIVHLQALLGNRWAAIASYLPERTD
LOC_Os09g24800.1_11979.m05634_protein_MYB     (52)  SCRLRWTNYLRPGIKRGNFTEQEEKLIVHLQALLGNRWAAIASYLPERTD
                              Zea MYB30 orth  (52)  SCRLRWTNYLRPGIKRGNFTEQEEKLIVHLQALLGNRWAAIASYLPKRTD
LOC_Os11g03440.1_11981.m04539_protein_MYB     (52)  SCRLRWTNYLRPGIKRGNFTAHEEGIIVHLQSLLGNRWAAIASYLPQRTD
LOC Os12g03150.1 11982.m04313 protein MYB     (52)  SCRLRWTNYLRPGIKRGNFTAHEEGIIVHLQSLLGNRWAAIASYLPQRTD
                                   Consensus (151)  SCRLRWTNYLRPGIKRGNFTEHEEKMIVHLQALLGNRWAAIASYLPQRTD

                                                    201                                              250
                                 AT1G08810.1 (102)  NDIKNYWNTHLKKKLNKSDSDE----------------------------
                                 AT1G74650.1 (102)  NDIKNYWNTHLKKKLVMMKFQNG INENKTN ATDISSCNNNNNGCNHNK
                                 AT3G47600.1 (102)  NDIKNYWNTHLKKKLKKMNDSCDSTINN  GLDNKDFSISNKN ITSHQS
                                 AT5G62470.1 (101)  NDIKNYWNTHLKKKLKKINESGE---E-----DNDGVSSSNTSSQKNHQS
                           Poplar MYB30 orth (102)  NDIKNFWNTHLKKKLRKLQAGQE       GQSRDGISSIGSQ
                                   At3g28910 (102)  NDIKNYWNTHLKKKLNKVNQDSHQELDRS--SLSSSP-----SSSSANSN
                                 AT3G28910.1 (102)  NDIKNYWNTHLKKKLNKVNQDSHQELDRS--SLSSSP-----SSSSANSN
                                     CDS3626 (102)  NDIKNYWNTHLKKKLNKVNQDSHQELDRS--SLSSSP-----SSSSANSN
LOC_Os03g26130.1_11973.m07957_protein_MYB    (102)  NDVKNFWNTHLKKKLALTSS                     SSSPPIPTT
LOC_Os07g43580.1_11977.m08585_protein_MYB    (102)  NDIKNYWNTHLKRKLQGGGAGGDGDGGA-----AGDA---VSPKPAAQRP
                              LOC Os08g33940 (201)  NDIKNYWNTHLKKKLKKMSATGGGGDDG-----EGGG------AGEVKTR
LOC_Os08g33940.1_11978.m07384_protein_MYB    (201)  NDIKNYWNTHLKKKLKKMSATGGGGDDG-----EGGG------AGEVKTR
LOC Os09g24800.1 11979.m05634 protein MYB    (102)  NDIKNYWNTHLKKKLKKMQAAGGGEDSGA--ASEGGGGRGDGDGGGKSVK
                              Zea MYB30 orth (102)  NDIKNYWNTHLKKKLKNMQ--GG--------E--GG------AGGKR---
LOC_Os11g03440.1_11981.m04539_protein_MYB    (102)  NDIKNYWNTHLKKKLAAAANSTSAAS-------------NRHPIFADATF
LOC_Os12g03150.1_11982.m04313_protein_MYB    (102)  NDIKNYWNTHLKKKLAAAANSTSSS--------------NRHPIFADATF
                                   Consensus (201)  NDIKNYWNTHLKKKL KMN                              T

                                                    251                                              300
                                 AT1G08810.1 (124)  -------R--SRSENIALQTSSTRNIINHRS-------------------
                                 AT1G74650.1 (152)  RTINKGQWEKKLQTDINMAKQALFQALSLDQP------------------
                                 AT3G47600.1 (149)  SNSSKGQWERRLQTDINMAKQALCDALSIDKP-----------------Q
                                 AT5G62470.1 (143)  TN  KGQWERRLQTDINMAKQALCEALSLDKPSSILSSSSSLPTPVITQQ
                           Poplar MYB30 orth (138)  -Q SRGQWERRLQTDINMARQA CEALSPGKP------------------
                                   At3g28910 (145)  SNISRGQWERRLQTDIHLAKKALSEALSPAVAP
                                 AT3G28910.1 (145)  SNISRGQWERRLQTDIHLAKKALSEALSPAVAP-----------------
                                     CDS3626 (145)  SNISRGQWERRLQTDIHLAKKSLSEALSPAVAP-----------------
LOC_Os03g26130.1_11973.m07957_protein_MYB    (131)  PLVARGQWERKLQTDIDLARRALRDALSVDDAA-----------------
LOC_Os07g43580.1_11977.m08585_protein_MYB    (144)  ASSSKGQWERRLQTDIDMARRALREALTSLDDV-----------------
                              LOC_Os08g33940 (240)  AAAPKGQWERRLQTDIHTARQALRDALSLDPSP-----------------
LOC Os08g33940.1 11978.m07384 protein MYB    (240)  AAAPKGQWERRLQTDIHTARQALRDALSLDPSP-----------------
LOC_Os09g24800.1_11979.m05634_protein_MYB    (150)  AAAPKGQWERRLQTDIHTARQALRDALSLDEP------------------
                              Zea MYB30 orth (131)  PAVPKGQWERRLQTDIHTARQALRDALSLEP-------------------
LOC_Os11g03440.1_11981.m04539_protein_MYB    (139)  PSAAG-SHTVSSNSDVNQMAAIARRSPFADCP------------------
LOC_Os12g03150.1_11982.m04313_protein_MYB    (138)  PSAAGGSYTVSSNSDVNQMAAIARRSPFADCP------------------
                                   Consensus (251)  A  SKGQWERRLQTDI LARQALRDALSLD
```

FIGURE 9 (continued)

```
                                                        301                                              350
                               AT1G08810.1   (146)                                             TYASSTE
                               AT1G74650.1   (184)  -------------------SS-LIPPDPDSPKPHHHSTITYASSTD----
                               AT3G47600.1   (182)  NPTNPS  IPDLGYGPSSSSSSTTTITITTRNTNPYPSGVYASSAE
                               AT5G62470.1   (191)  N RNFSSALLDRCYDPSSSSS-STT T TSNTTNPYPSGVYASSAE----
                         Poplar MYB30 orth   (169)  -------------------SSLLIGLKPSCGYEKPAIEPIYASSTE----
                                 At3g28910   (178)  ----IITSTVTTISSSAES--RRSTSSASCFLRTQEISITYASSTE----
                               AT3G28910.1   (178)      IITSTVTTISSSAES  RRSTSSASGFLRTQEISITYASSTE
                                   CDS3626   (178)  ----IITSTVTTISSSAES--RRSTSSASCFLRTQEISITYASSTE----
   LOC_Os03g26130.1_11973.m07957_protein_MYB (164)  ----SP-------------------AMISSGPPAPAAAAAYALSER----
   LOC_Os07g43580.1_11977.m08585_protein_MYB (177)  ----KPPHQPDAANAAAGGGATIGAAASAGADSPAASSTSGASQCSPSS
                            LOC_Os08g33940   (273)  ----PAKPLDS--------------SSGATAPPSSQAAISYASSAE----
   LOC_Os08g33940.1_11978.m07384_protein_MYB (273)  ----PAKPLDS--------------SSGATAPPSSQAAISYASSAE----
   LOC_Os09g24800.1_11979.m05634_protein_MYB (182)  ----DPSPATA--------------AAAATPAGS---SAAYASSAD----
                           Zea MYB30 orth    (162)  ----SATPLAK--------------VEPLPTAPG---CATYASSAD----
   LOC_Os11g03440.1_11981.m04539_protein_MYB (170)  -------------------------------------SSSYASSMD----
   LOC_Os12g03150.1_11982.m04313_protein_MYB (170)  -------------------------------------SSSYASSMD----
                                 Consensus   (301)                           S  S        SITYASS E

                                                        351                                              400
                               AT1G08810.1   (153)  --------NISRLLEGWMRASPKSSISITPLPHKMQNRINKFIDHHSDQF
                               AT1G74650.1   (210)  --------NISKLIQNWTSSSSS----KPN--TSSVSNNRSSSP------
                               AT3G47600.1   (226)  --------NIARLIQNPMKDTPKISVPLPVAATEMAITIAASSPST----
                               AT5G62470.1   (236)          NIARLIQDIMKDTPK A  LTLSSSSPVSEIGPLIAAV
                         Poplar MYB30 orth   (196)  --------NISRLIKCWMISCPKQSLKNSITQNSFIDTACADSLSSECTP
                                 At3g28910   (218)  --------NIAKLIKGWVKNSP------KTQNSADQIASTEVKEVIKSD-
                               AT3G28910.1   (218)  --------NIAKLIKGWVKNSP------KTQNSADQIASTEVKEVIKSD-
                                   CDS3626   (218)  --------NIAKLIKGWVKNSP------KTQNSADQIASTEVKEVIKSD-
   LOC_Os03g26130.1_11973.m07957_protein_MYB (187)  --------NISVMISGWAAPPPARKGLSACNPAAATITPGGAAAES----
   LOC_Os07g43580.1_11977.m08585_protein_MYB (223)  AGYVLTIENISRMIDGWARKKGGGGGRRAAG--SGPATPGATESAS----
                            LOC_Os08g33940   (301)  --------NIARLIEGWMRPGGGG----------GKITITPSS-------
   LOC_Os08g33940.1_11978.m07384_protein_MYB (301)  --------NIARLIEGWMRPGGGG----------GKITITPSS-------
   LOC_Os09g24800.1_11979.m05634_protein_MYB (207)  --------NIARLIQGWMRPGGGGGNGKGPEASGSISITATIQQPQC-
                           Zea MYB30 orth    (187)  --------NIARLIEGWLRPG-----SGKGPEASGSISITATTRQRPQC-
   LOC_Os11g03440.1_11981.m04539_protein_MYB (179)          NISKLIDGIMKTNSPSPPPPPLQHYDGGYYDDVKPAVDVV
   LOC_Os12g03150.1_11982.m04313_protein_MYB (179)  --------NISKLIDGIMKTNSPSPPPPPLQHYDSGYYDDVKPAVDVG--
                                 Consensus   (351)          NIARLI GWMK  P           S   TI   S

                                                        401                                              450
                               AT1G08810.1   (195)  PYEQLQGSWEEGHSKG--------INGDDIQGIKNSENNNGDIVHHEDGD
                               AT1G74650.1   (240)  ---CECCLFDHHSIFSSNSESCSVDEKLNLMSETSMFKCE-SKPDIDMEA
                               AT3G47600.1   (264)  --TEGDGEGIDHSIFS----FNSIDEAE-------------EKPKLIDHD
                               AT5G62470.1   (271)  --SEEGGEGFEQSFFS----FNSMDETQNLTQETSFFHDQVIKPEITMDQ
                         Poplar MYB30 orth   (238)  DKADKNGIGLSQAFESLFG-FDSFDSSNS-------DFSQSMSPDTGLFQ
                                 At3g28910   (253)  --DGKECAGAFQSFSE---------FDESYQQAGVSPDEETKPDITGCCS
                               AT3G28910.1   (253)  --DGKECAGAFQSFSE---------FDESYQQAGVSPDEETKPDITGCCS
                                   CDS3626   (253)  --DGKECAGAFQSFSE---------FDESYQQAGVSPDEETKPDITGCCS
   LOC_Os03g26130.1_11973.m07957_protein_MYB (225)  ----ASTAGTSLEIIA---------DCCSGGGDSSASNCLPSSMLLACDD
   LOC_Os07g43580.1_11977.m08585_protein_MYB (267)  ----GSSEASEVSYGG---------IALS---AAAAPASAPEYETKPTVI
                            LOC_Os08g33940   (326)  ---GSRSSAASVLSGE---------ASESGGATAPTPDGSTVTSKTKDEE
   LOC_Os08g33940.1_11978.m07384_protein_MYB (326)     GSRSSAASVLSGE         ASESGGATAPTPDGSTVISKTKDEE
   LOC_Os09g24800.1_11979.m05634_protein_MYB (248)  --SGEGAASASASASQ---------SGAAAAATAQTPECSTETSKMATGG
                           Zea MYB30 orth    (223)    SGEGTASASASHS          GGAAANTAAQTPECSTETSKMAGSS
   LOC_Os11g03440.1_11981.m04539_protein_MYB (219)  ---GNPLLSSFDCMSGADLDCCFDVEQQQP---ASSFMEYGGYGGGYGDE
   LOC_Os12g03150.1_11982.m04313_protein_MYB (219)  ---GNPLLSSFDCMSGADLDCCFDVEQQHQQQPASFMEYGGYGGGYGDE
                                 Consensus   (401)     G   AGA  S S              S    A SP    T
```

FIGURE 9 (continued)

```
                                                     451                                            496
                                 AT1G08810.1  (237)  HEDDDDHNATPPLTFIEKWLLEETSTTGGQMEEMSHLMELSNML--
                                 AT1G74650.1  (286)  TPTTTTTDDQGSLSLIEKWLFDDQGLVQCDDSQEDLLDVSLEELK-
                                 AT3G47600.1  (295)  INGLIT---QGSLSLFEKWLFDEQSHDMIINNMSLEGQEVLF----
                                 AT5G62470.1  (315)  DHGLIS---QGSLSLFEKWLFDEQSHEMVG--MALAGQEGMF----
                           Poplar MYB30 orth  (280)  DESKPNSSAQVPISLIERWLFDEGAMQGKDYINEVIDEDNLF---
                                   At3g28910  (292)  NQSQ-------WS-LFEKWLFEDSGG------QIGDLLLDENTNFF
                                 AT3G28910.1  (292)  NQSQ-------WS-LFEKWLFEDSGG------QIGDLLLDENTNFF
                                     CDS3626  (292)  NQSQ-------WS-LFEKWLFEDSGG------QIGDLLLDENTNFF
LOC_Os03g26130.1_11973.m07957_protein_MYB  (262)  GDATATAAGVAPISATESWLLLDDSGEPQIALDEQLLDVAIRNYAF
LOC_Os07g43580.1_11977.m08585_protein_MYB  (301)  AAAAADAGDETQLSAIESWLFADADG-----IESGSLLDAAMDYTF
                            LOC_Os08g33940  (364)  TAGAPPPPPPPAFSMLESWLLDDGMGHGEVGLMDVVVPLGDPSEFF
LOC_Os08g33940.1_11978.m07384_protein_MYB  (364)  TAGAPPPPPPPAFSMLESWLLDDGMGHGEVGLMDVVVPLGDPSEFF
LOC_Os09g27800.1_11979.m05634_protein_MYB  (287)  GAGG----PAPAFSMLESWLLDDGG-----MGLMDVVPLGDPSF--
                              Zea MYB30 orth  (261)  VGAG----SAPAFSMLERWLLDDGMGHAEVGLMTDVVPLGDPSEFF
LOC_Os11g03440.1_11981.m04539_protein_MYB  (263)  SKQQLMNQAAAPISSIEKWLFDEAAAEQVADLMDISDGCCSVPMMF
LOC_Os12g03150.1_11982.m04313_protein_MYB  (266)  SKQQLMNQAAPPISSIEKWLFDEAAAEQVADLMDISDGCCSVPMMF
                                   Consensus  (451)    S            ISLIEKWLFDDGGG        LM        F
```

FIGURE 9 (continued)

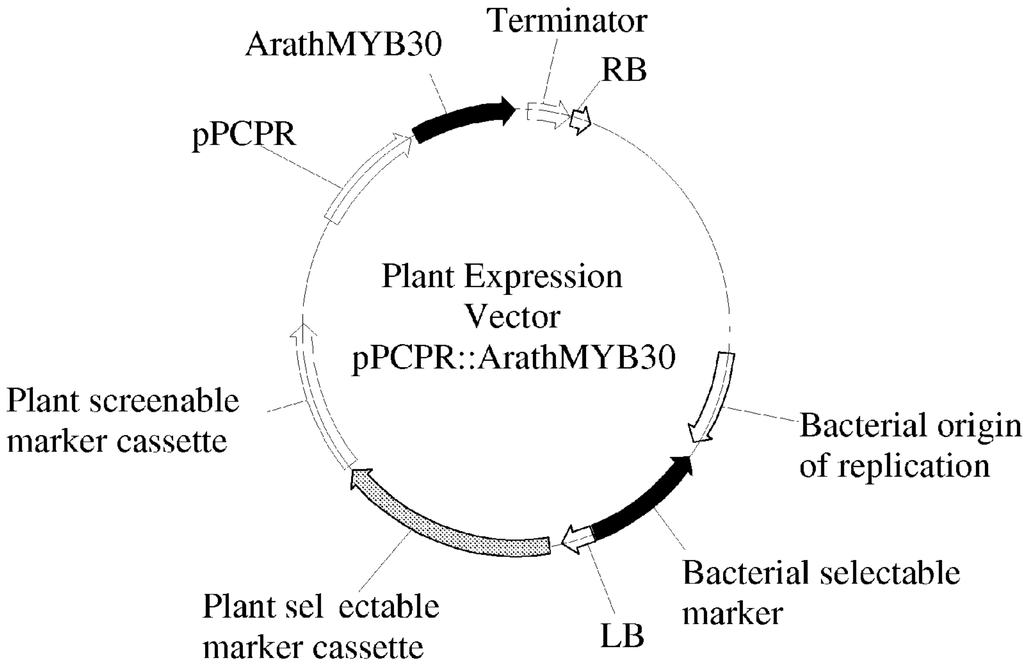

FIGURE 10

MSSEKEDGLGLSLSLGIMSCPQNNHKTTPS

LPLNLLPFMHHHQVSSGRKDEGGERVRGGI

DMNEPARMIIECDDEEDEEEDQVLMVSSPN

STVSSVSGKRSHDREENEGERATSSLEDDG

GDAAARKKLRLSKEQAAVLEETFKEHNTLN

PKQKLALSKQLNLRPRQVEVWFQNRRARTK

LEQTEVDCEYLKRCCENLTDENRRLQKEVS

ELRALKLSPQFYMNMSPPTTLTMCPQCERV

AVSSSSSSSVVNATRAQNHQAPVPMNKPW

AAMFASKTLDVQRSQM

FIGURE 11

```
CLUSTAL 2.0.3 multiple sequence alignment

Os10g41230          ----------------------MEMMVHGRRDEQYGGLRLGLGLGLSLGVAGGAADDEQP
Os_CAA65456         ----------------------MEMMVHGRRDEQYGGLGLGLGLGLSLGVAGGAADDEQP
Zm_07MC27159        ------------------------------------------------------------
Pt_40.143           ---------------------------------MGDK-NDGLGLSLSLGFD-ATQQNHQQ
Pt_II.1260          ---------------------------------MGDK-NDGLGLSLSLGY--ATQRNHHQ
Pt_286586           ------------------------------------------------------------
At3g60390           ---------------------------------MSER-DDGLGLSLSLSLG-FNQKD---
At2g44910           ---------------------------------MGER-DDGLGLSLSLGN--SQQKE---
Sl_TA56840          --------------------------------MSSEK-EDGLGLSLSLGIMSCPQNNHKT
Le_THOM             --------------------------------MSSEK-EDGLGLSLSLGIMSCPQNNHKT
Pt_29.72            --------------------------------MMAGK--EDLGLSLSLSVP-QNQHSLQL
At4g16780           --------------------------------MMFEK--DDLGLSLGLNFP-KKQINLKS
Sl_BAD27255         ---------------------------------------------------------MR-
Sl_TA49906          --------------------------------MMVEK--EDLGLSLSLSFPDNNNNNKKK
Pb_CAA64221         --------------------------------MMIHQREDHLGLSLSLSSPAHRPSSSSS
Gm_Q39862           --------------------------------MTVQK--EDLGLSLSLSFPLLSSSPSSH
At5g47370           --------------------------------MMMGK--EDLGLSLSLGFS-QNHNPLQM
At4g17460           --------------------------------MMMGK--EDLGLSLSLGFA-QNH-PLQL
Cp_AF443619         -------------------------------------------LGLSLGSFGPSSSGGSH
Ps_ABK24536         MDLGLGLGGEDIVVRPAESWIQFQNMTSATKADLVQNTELFLRLGLELGSQRQNTANPNP
Pt_XVI.516          -------------------------------MELALSLGDT---SKPFKFLDKTPKL---
Pt_VI.1202          -------------------------------MELALSLGDT---SKPFKFLDKTPKL---
Pt_ABK95369         -------------------------------MELGLSLGDAATASKPFGFMEKSTKL---
Mt_DW016069_ps      ------------------------------------------------------------
At5g06710           -------------------------------MELALSLGDN--TKKQFSFMEKNSKINNP
Os04g4635012004     ------------------------------MMERAEDLR----LSLSLSSPLIAPRT---
Gm_06MC31751        ------------------------------MMGLDQDASSNSGLQLILGLALTATTTT--
Os_Q84U86           --------------------------------------MMDLGLSLGLGLASQGSLTSST
Ta_ABC86568         --------------------------------MMHRADGLDLGLGLGLGLASQGSITSST
Os06g04850          ----------------------------------MERQGLDLGLSLGLGLTTAATWPAAG
```

FIGURE 12

```
Os10g41230          PPRRGAAPPPQQQLCGWNG-----------------GGLFSSSSSDHRGRSAMMACHD--
Os_CAA65456         PPRRGAAPPPQQQLCGWNG-----------------GGLFSSSSSDHRGRSAMMACHDV-
Zm_07MC27159        ------------------------------------------------------------
Pt_40.143           QPSLKLNLMPVPS------------QNNH------RKTSLTDLFQSS-------DRAC--
Pt_II.1260          QPSLKLNLMPLAS------------QNKH------KKTSWTDLFQSP-------DRTC--
Pt_286586           ------------------------------------------------------------
At3g60390           -PSSRLNPMPLASYASSSHMQHMQ-QSNYNHPQKIQN-TWINMFQSS-------ERNS--
At2g44910           -PSLRLNLMPLTTSSSSSSFQHMHNQNNNSHPQKIHNISWTHLFQSSGIKRTTAERNS--
Sl_TA56840          TPSLPLNLLPFMH---------------------------HHQVSSG-------RKDE--
Le_THOM             TPSLPLNLLPFMH---------------------------HHQVSSG-------RKDE--
Pt_29.72            NLMPSLVPSTASSSLSGFHPQ---------------KPSWNVTFPSSD--PNSNSYRA--
At4g16780           NPSVSVTPS--SSSFGLFR-----------------RSSWNESFTSSV--PNSDSSQK--
Sl_BAD27255         ------------------------------------------------------------
Sl_TA49906          NTQLNLSPFNLIQKTSWTD-------------------SLFPSSDRN-----IETCRV--
Pb_CAA64221         PLQLNLAPSMPTPSTPPFN-------------------LFHKKETSDG--YILDACRV--
Gm_Q39862           NPQKP---------------------------------SWNDPIFTS---------SG--
At5g47370           NLNPNSSLSNNLQRLP-----------------------WNQTFDP--------TSD---
At4g17460           NLKPTSSPMSNLQMFP-----------------------WNQTLVS--------SSDQ--
Cp_AF443619         PP-----PALPLPSNLFRPSLQEIDRTQR--------SIGAFLQAPTAAAVCR-------
Ps_ABK24536         PIQLDLLPAAPVPRGFSWHPNTKTYRAAS--------ENGNCEGDYGETRSCGQGGGA--
Pt_XVI.516          ------SSKD-LGFCMGLGSGFP--------ATTRSQDKLGSHESN-YQDDERRVSS---
Pt_VI.1202          ------SSKD-LGFCMGLGSGFT--------ASTRSHDKLGSHENN-HQEDERRVSS---
Pt_ABK95369         ------TNKASLGFCMGLSIGQN--------HTPQEDEDKEKHGNNDHKSDNTNTTTTAE
Mt_DW016069_ps      ------------------------------------------------------------
At5g06710           SVSSTSTSEKDLGFCMALDVAFGGHRSLSSSSSPSVEDEKKKPAPRAKKSDEFRVSSS--
Os04g4635012004     -----------------------------------HHVAMLFHAPPEKR-----------
Gm_06MC31751        ------TPSSPPSISNKL-------------DHVDHHHHLITLRPTTKSSYNSSEAEP--
Os_Q84U86           TTTSSPGAGSSSP---WAA-----------------------------------------
Ta_ABC86568         TTAASSSPASASHSQHWTA-----------------------------------------
Os06g04850          FCLNSGMAEQEVIR----------------------------------------------
```

FIGURE 12 (continued)

```
Os10g41230          ------------VEMPFLRGIDVNRAP--------------AAETTTTTARGP-------
Os_CAA65456         ------------IEMPFLRGIDVNRAP--------------AAETTTTTARGP-------
Zm_07MC27159        --------------MPFLRGVDVNRAP--------------AGDTR----RG--------
Pt_40.143           ------------GTRFFQRGIDMNRVP----------------AAVT-------------
Pt_II.1260          ------------DTRLFQRGIDMNRVP----------------AAVA-------------
Pt_286586           ----------------FQRGIDMNRVP----------------AAVT-------------
At3g60390           ------------DMRSFLRGID-NRAP---------------STVVV-------------
At2g44910           ------------DAGSFLRGFNVNRAQS--------------SVAVV-------------
Sl_TA56840          ------------GGERVRGGIDMNEPA----------------RMII-------------
Le_THOM             ------------GGERVRGGIDMNEPA----------------RMII-------------
Pt_29.72            ------------ETRSLLRGIDVNRLP----------------STA--------------
At4g16780           ------------ETRTFIRGIDVNRPP----------------STA--------------
Sl_BAD27255         ------------------------------------------------------------
Sl_TA49906          ------------ETRTFLKGIDVNRLP----------------ATG--------------
Pb_CAA64221         ------------ETRSFLKGIDVNRLP----------------ATTV-------------
Gm_Q39862           ------------EAGSFLRGIDVNRLP----------------SVV--------------
At5g47370           -----------------LRKIDVNSFP----------------STV--------------
At4g17460           ------------QKQQFLRKIDVNSLP----------------TTV--------------
Cp_AF443619         ------------EPASAFRGIDVNRPP-----------------TIV-------------
Ps_ABK24536         ------------ASASSPRGFDVNRVP-----------------SSA-------------
Pt_XVI.516          ------------DPPLQLDLLPFSPVPRGHQAPSRIRFPWLTDNLVSEPGSTEAPGRRFD
Pt_VI.1202          ------------DPPLQLVLLPFSPVPRRHQPPSKTRFPWLTDNLVSEPGSTEGSGRGFD
Pt_ABK95369         ANKRKGLTVDTTDSPIQLDLLPNTPVPRNRNSSP--------TYVVYDNGNMS---RGFD
Mt_DW016069_ps      ----------------------------GRAAAT--------------------------
At5g06710           -----------VDPPLQLQLHFPNWLPENSKGRQGGRMPLGAATVVEE------------
Os04g4635012004     ----------------------FLEMPLLPAAKR--------SEVVA-------------
Gm_06MC31751        ------------SLTLGLSRESYLKVPKSIIGHN--------NNKVS-------------
Os_Q84U86           ------------ALNSIVGDVRRDQAAA--------------HAAAA-------------
Ta_ABC86568         ------------ALSSVIG-LRKEEP----------------------------------
Os06g04850          -------------RDDVVAATAAEDE----------------------------------
```

FIGURE 12 (continued)

```
Os10g41230        -------SCSEEDEEPG--------ASSPNSTLSS-----LSGKRGAPS-----------
Os_CAA65456       -------SCSEEDEEPG--------ASSPNSTLSS-----LSGKRGAPS-----------
Zm_07MC27159      -------SCSEDDEEPGGA------SSSPNSTLSSS----LSGKRAAPARSGGEVA----
Pt_40.143         ----------DCDDETG--------VSSPNSTLSS----LS-GKRSEREQIGEE------
Pt_II.1260        ----------DCDDETG--------VSSPNSTLSS----LISGKRSEREQIGEE------
Pt_286586         ----------DCDDETG--------VSSPNSTLSS----LS-GKRSEREQIGEE------
At3g60390         ----------DVEDEGAG-------VSSPNSTVSS----VMSGKKSERELMAAAGAVGGG
At2g44910         ----------DLEEEAAV-------VSSPNSAVSS-----LSGNK--RDLAVAR----GG
Sl_TA56840        ----------ECDDEEDEEEDQVLMVSSPNSTVSS----VS-GKRS---HDREE------
Le_THOM           ----------ECDDEEDEEEDQVLMVSSPNSTVSS----VS-GKRS---HDREE------
Pt_29.72          ----------DCEEEAG--------VSSPNSTIS-----SISGKRS--EREGING---D-
At4g16780         ----------YGDEDAG--------VSSPNSTVS-----SSTGKRS--ERE---------
Sl_BAD27255       ----------------G--------VASPNSTVS-----TVSGKRSLCERDSTSAGAAD-
Sl_TA49906        ----------DANKEAG--------VSSPNSTIS-----SVSGNKRS-EREANNC-----
Pb_CAA64221       ----------DMEEEAG--------VSSPNSTIS-----SVSGKRSL-ERSENGN-----
Gm_Q39862         ----------DCEEEAG--------VSSPNSTVS-----SVSGKRS--ERETNGE-----
At5g47370         ----------NCEEDTG--------VSSPNSTIS-----TISGKR--SEREGISGTGVGS
At4g17460         ----------DLEEEIG--------VSSPNSTISS----TVSGKRRSTEREGTSGGGCG-
Cp_AF443619       ----------DCGEENNNP----IASPSPNSTVCS-----SSGKRTSGEREEKE------
Ps_ABK24536       ----------DNDNEDDDD----AAVSSPNSTISSFQMDFAICHATSAVKRER-------
Pt_XVI.516        VNRLS-----MDDADEG----AAISS--PNSAASSFQMDFGIRSG---RDR-KRDL----
Pt_VI.1202        VNRLS-----MDDADEG----AALSS--PNSAASSFQMDFGIRSG---RGN-KRDL----
Pt_ABK95369       VNRFPAVMVHEDQADQDV---AALSSSPPNSATSSFQMDFCMYSS---KGRSESHN----
Mt_DW016069_ps    ----------TEDVDDG----TSLSS--PSSSVSPFAMDFSMRNN---NNAEYGGR----
At5g06710         ----------EEEEEEAV---PSMSVSPPDSVTSSFQLDFGIKSYGY-ERRSNKRD----
Os04g4635012004   ----------AEEERAGL---RGGGGS---------------------------------
Gm_06MC31751      ----------SCDDPLDL---STQTNSPHHSAVSSFSSGRVKRERDLSCEEVVDAK----
Os_Q84U86         ----------VGVGVGGEEMYQGRASTSPDSAAALS---SASGKRERELERSGS------
Ta_ABC86568       -----------GV----------QASTSPE-----------SGGTKRGLERTGSGL----
Os06g04850        -----------------------RFACSPGSPVS-------SGSGKRGS-GSGS------
```

FIGURE 12 (continued)

```
Os10g41230          ------AATAAAAAAS--------DDEDSGGG-------SRKKLRL-KDQAAVLEDTFKE
Os_CAA65456         ------AATAAAAAAS--------DDEDSGGG-------SRKKLRLSKDQAAVLEDTFKE
Zm_07MC27159        ------DHTPRAGGGS--------DDEDSGGG-------SRKKLRLSKDQAAVLEESFKE
Pt_40.143           ------TEAERASCSR--DS---DDEDG-AGGD-----ASRKKLRLSKEQSLVLEETFKE
Pt_II.1260          ------TEAERASCSR--GS---DDED---GGD-----ASRKKLRLSKEQSSVLEENFKE
Pt_286586           ------TEAERASCSR--DS---DDEDG-AGGD-----ASRKKLRLSKEQS-VLEETFKE
At3g60390           R--VEDNEIERASCSLGGGS---DDEDGSGNGD-----DSSRKLRLSKEQALVLEETFKE
At2g44910           ----DENEAERASCSRGGGSGGSDDEDG-GNGD-----GSRKKLRLSKDQALVLEETFKE
Sl_TA56840          ------NEGERATSSL--------EDDG--GDA-----AARKKLRLSKEQAAVLEETFKE
Le_THOM             ------NEGERATSSL--------EDDG--GDA-----AARKKLRLSKEQAAVLEETFKE
Pt_29.72            -----EHEMERASSHG--------ISDEEDG-E-----TSRKKLRLSKDQAAILEESFKE
At4g16780           ------EDTDPQGSRG--------ISDDEDG-D-----NSRKKLRLSKDQSAILEETFKD
Sl_BAD27255         -----DLDLERASSRG--------LSDDEDGGD-----NSRKKLRLTKDQSAILEDSFKE
Sl_TA49906          ------DQEEHEMERG--------GSDEEDG-E-----TSRKKLRLSKDQSAILEESFKE
Pb_CAA64221         ------GDDLLDCSRGL------INSDEEDG-D-----NSRKKLRLSKDQSAILEDSFKE
Gm_Q39862           -----ENDTDRACSRG-------IISDEEDA-E-----TSRKKLRLSKDQSIVLEESFKE
At5g47370           GDDHDEITPDRGYSRGT------SDEEED-GGE-----TSRKKLRLSKDQSAFLEETFKE
At4g17460           --DDLDITLDRSSSRGT------SDEEEDYGGE-----TCRKKLRLSKDQSAVLEDTFKE
Cp_AF443619         -------DGDRAASSS-----FEVEDDDGGGGD----ASARKKLRLSKEQAVVLEETFKE
Ps_ABK24536         -------DGERDNNAND----NELDRDCSRGSDEEEGGGTRKKLRLSKEQSAYLEESFKE
Pt_XVI.516          ----DAIDAERASSRAS--------DDDENGL-------TRKKLRLSKEQSAFLEESFKE
Pt_VI.1202          ----EAIEASRAS------------DDEENGL-------TRKKLRLSKDQSAFLEESFKE
Pt_ABK95369         ----EADQAERASSRAS--------DEDENGS-------ARKKLRLSKDQSAFLEESFKE
Mt_DW016069_ps      ----NKRENEGEAERGS--------DDDENGS-------TRKKLRLSKDQSAFLEESFKE
At5g06710           ----IDDEVERSASRASN-----EDNDDENGS-------TRKKLRLSKDQSAFLEDSFKE
Os04g4635012004     ------DEEDGGCG--------------IDG--------SRKKLRLSKDQSAVLEDSFRE
Gm_06MC31751        ----EIDQRDLSCEGIIR-----ATEEEEDGAA------TRKKLRLTKEQSALLEESFKQ
Os_Q84U86           -------GVD-DDDGA----------DGAGG---------RKKLRLSKDQAAVLEECFKT
Ta_ABC86568         -----AAGSDEDDDGG----------DGTGG---------RKKLRLSKDQAAVLEECFKT
Os06g04850          -------GDEVDDAGC----------DVGGGGA-------RKKLRLSKDQAAVLEECFKT
                                                              :**** *:*:  **: *:
```

FIGURE 12 (continued)

```
Os10g41230          HNTLNP--------------KQKAALARQLNLKPRQVEVWFQNRRARTKLKQTEVDCELL
Os_CAA65456         HNTLNP--------------KQKAALARQLNLKPRQVEVWFQNRRARTKLKQTEVDCELL
Zm_07MC27159        HNTLNP--------------KQKAALAKQLNLKPRQVEVWFQNRRARTKLKQTEVDCEFL
Pt_40.143           HNTLNP--------------KEKLALAKQLNLRPRQVEVWFQNRRARTKLKQTEVDCEYL
Pt_II.1260          HNTLNPVSSSLWYVVVLWLQKEKLALAKQLNLRPRQVEVWFQNRRARTKLKQTEVDCEYL
Pt_286586           HNTLNP--------------KEKLALAKQLNLRPRQVEVWFQNRRARTKLKQTEVDCEYL
At3g60390           HSTLNP--------------KQKMALAKQLNLRTRQVEVWFQNRRARTKLKQTEVDCEYL
At2g44910           HSTLNP--------------KQKLALAKQLNLRARQVEVWFQNRRARTKLKQTEVDCEYL
Sl_TA56840          HNTLNP--------------KQKLALSKQLNLRPRQVEVWFQNRRARTKLKQTEVDCEYL
Le_THOM             HNTLNP--------------KQKLALSKQLNLRPRQVEVWFQNRRARTKLEQTEVDCEYL
Pt_29.72            HNTLNP--------------KQKMALAKQLGLRPRQVEVWFQNRRARTKLKQTEVDCEFL
At4g16780           HSTLNP--------------KQKQALAK-LGLRARQVEVWFQNRRARTKLKQTEVDCEFL
Sl_BAD27255         HNTLNP--------------KQKLALAKRLGLGPRQVEVWFQNRRARTKLKQTEVDCEFL
Sl_TA49906          HNTLNP--------------KQKLALAKRLGLRPRQVEVWFQNRRARTKLKQTEVDCEFL
Pb_CAA64221         HNTLNP--------------KQKLALAKRLGLRPRQVEVWFQNRRARTKLKQTEVDCEFL
Gm_Q39862           HNTLNP--------------KQKLALAKQLGLRARQVEVWFQNRRARTKLKQTEVDCEFL
At5g47370           HNTLNP--------------KQKLALAK-LNLTARQVEVWFQNRRARTKLKQTEVDCEYL
At4g17460           HNTLNP--------------KQKLALAKKLGLTARQVEVWFQNRRARTKLKQTEVDCEYL
Cp_AF443619         HSTLNP--------------KEKIALAKQLNLMPRQVEVWFQNRRARTKLKQTEVDCEYL
Ps_ABK24536         HNTLNP--------------KQKLALAKQLNLRPRQVEVWFQNRRARTKLKQTEVDCEYL
Pt_XVI.516          HNTLNP--------------KQKLALAKQLNLRPRQVEVWFQNRRARTKLKQTEVDCEYL
Pt_VI.1202          HSTLNP--------------KQKLALAKQLNLRPRQVEVWFQNRRARTKLKQTEVDCEYL
Pt_ABK95369         HNTLTP--------------KQKLALAKELNLRPRQVEVWFQNRRARTKLKQTEVDCEYL
Mt_DW016069_ps      HTTLNP--------------KQKLALAKQLNLSPRQVEVWFQNRRARTKLKQTEVDCEYL
At5g06710           HSTLNP--------------KQKIALAKQLNLRPRQVEVWFQNRRARTKLKQTEVDCEYL
Os04g4635012004     HPTLNP--------------RQKATLAQQLGLRPRQVEVWFQNRRARTKLKQTEVDCEFL
Gm_06MC31751        HSTLNP--------------KQKQALSKQLNLRPRQVEVWFQNRRARTKLKQTEVDCEFL
Os_Q84U86           HSTLNP--------------KQKVALANRLGLRPRQVEVWFQNRRARTKLKQTEVDCEYL
Ta_ABC86568         HSTLNP--------------KQKTALANRLGLRPRQVEVWFQNRRARTKLKQTEVDCEYM
Os06g04850          HHTLTP--------------KQKVALAKSLNLRPRQVEVWFQNRRARTKLKQTEVDCEHL
                    * **.*              ::* :*:. *.* .***************:******* :
```

FIGURE 12 (continued)

```
Os10g41230          KRCCETLTDENRRLHRELQEL-ALKLATAAAAPHHLYGARVP---PPTTLTMCPSCERVA
Os_CAA65456         KRCCETLTDENRRLHRELQELRALKLATAAAAPHHLYGARVP---PPTTLTMCPSCERVA
Zm_07MC27159        KRCCETLTEENRRLQREVAELRALKLV----APHHY--ARMP---PPTTLTMCPSCERLA
Pt_40.143           KRCCENLTEENRRLQKEVQELRALKLS-------PQLYMHMN---PPTTLTMCPSCERVA
Pt_II.1260          KTCCENLTEENRRLLKEVQELRALKLS-------PQLYMHMN---PPTTLTMCPSCKRV-
Pt_286586           KRCCENLTEENRRLQKEVQELRALKL--------PQLYMHMN---PPTTLTMCPSCERVA
At3g60390           KRCCENLTDENRRLQK-VSELRALKLS-------PHLYMHMK---PPTTLTMCPSCERVA
At2g44910           KRCCDNLTEENRRLQKEVSELRALKLS-------PHLYMHMT---PPTTLTMCPSCERVS
Sl_TA56840          KRCCENLTDENRRLQKEVSELRALKLS-------PQFYMNMS---PPTTLTMCPQCERVA
Le_THOM             KRCCENLTDENRRLQKEVSELRALKLS-------PQFYMNMS---PPTTLTMCPQCERVA
Pt_29.72            KRCCENLTEENRRLQKEVQELRALKLS-------PQFYMQMT---PPTTLTMCPSCERVA
At4g16780           RRCCENLTEENRRLQKEVTELRALKLS-------PQFYMHMS---PPTTLTMCPSCEHVV
Sl_BAD27255         KRCCEQLTEENRRLQKEVQELRTLKLS-------PQFYMQMT---PPTTLTMCPSCERVA
Sl_TA49906          KRCCENLTEENRRLQKEVQELRALKLS-------PQFYMQMT---PPTTLTMCPSCERVA
Pb_CAA64221         KRCCENLTDENRRLMKEVQELRALKLS-------PQFYMQMT---PPTTLTMCPSCERVS
Gm_Q39862           KRCCENLTEENRRLQKEVQELRALKLS-------PQFYMHMT---PPTTLTMCPSCERVA
At5g47370           KRCVEKLTEENRRLQKEAMELRTLKLS-------PQFYGQMT---PPTTLIMCPSCER-G
At4g17460           KRCVEKLTEENRRLEKEAAELRALKLS-------PRLYGQMS---PPTTLLMCPSCERVA
Cp_AF443619         RRCCENLTEENRRLQKEVNELRALKLS-------PQFYMS-----PPTTLTMCPQCERVA
Ps_ABK24536         KRCYETLTEENRRLQKDIQELRALKVAH------PSFYMHL----PATTLTMCPSCERIA
Pt_XVI.516          KRCCETLTEENRRLQKELQELRALKTSQ------P-FYMQL----PATTLTMCPSCERVA
Pt_VI.1202          KRCCETLTKENRRLQKELQELRALKTSQ------P-FYMQL----PATTLTMCPSCERVA
Pt_ABK95369         KRCCETLTEENRRLHKELQELRALKTSN------P-FYMQL----PATTLTMCPSCERVA
Mt_DW016069_ps      KRCCETLTEENRRLQKELQELRALKTTQ------P-FYMQL----PATTLTMCPSCERVA
At5g06710           KRCCESLTEENRRLQKEVKELRTLKTST------P-FYMQL----PATTLTMCPSCERVA
Os04g4635012004     KRCCETLTEENRRLQKEVQELRALKLVS------PHLYMNMS---PPTTLTMCPSCERVS
Gm_06MC31751        KKCCETLTDENRRLQKELQELKALKLAQ------P-LYMPM----PAATLAMCPSCERLG
Os_Q84U86           KRWCERLADENKRLEKELADLRALKAAP----SPASASAMQPSSSAAATLTMCPSCRRVA
Ta_ABC86568         KRCCEQLAEQNRRLEKEVAELRALKAAP----PAHSAAAAAG---PLTTLTMCLSCKRVA
Os06g04850          KRWCDQLADDNRRLHKELAELRALKATP----TPP---AAAP---PLTTLTMCLSCKRVA
                    :   : *:.:*:** :   :* :**                    . :** ** .*.:
```

FIGURE 12 (continued)

```
Os10g41230          SAAT------------------TTRNNSGAAPAR-------------PVPTR--PWPPAA
Os_CAA65456         SAAT------------------TTRNNSGAAPAR-------------PVPTR--PWPPAA
Zm_07MC27159        SASA------------------SADQAGRAGPCWG------------PLP----VFVDGP
Pt_40.143           VSSA------------------SSSSAAAASSALAPTASTRQPQRPVPIN----PWATMP
Pt_II.1260          VSSA------------------SSSSAAVVSSALAPIASTPQPQRPVPIN----PWAAMP
Pt_286586           VSSA------------------SS------------------------------------
At3g60390           VTSS------------------SSSVAPPVMNSSSPMG---------PMS----PWAAMP
At2g44910           SSAA------------------TVTAAPSTTTTPTVVGR----PSPQRLT----PWTAIS
Sl_TA56840          VSSS------------------SSSSSVVNATRAQNHQA------PVPMNK---PWAAMF
Le_THOM             VSSS------------------SSSSSVVNATRAQNHQA------PVPMNK---PWAAMF
Pt_29.72            APPT------------------ASSTVDARPHPHIGPTR----HRPVPMNP----WAPAA
At4g16780           PPPQ------------------PQAATSAH-------------HRSLPVNA----WAPAT
Sl_BAD27255         APPS------------------GPVQPKPHPSLE-SRSS----IRPVANNP----WVTAA
Sl_TA49906          GPPP------------------SSSGPTSTPMGQAQPRP-------MPFNL----WANAL
Pb_CAA64221         APPS------------------SSTGPSSTPVETPRPHHSGSSHHRVAFNP----WAIAP
Gm_Q39862           VPPS------------------SAVDPATRHHHVPPSHP-----RAFPIGHGQALRCPPS
At5g47370           GPSS------------------SNHHHNHRP---------------VSINP----WVACA
At4g17460           GPSS------------------SN--HNQRS---------------VSLSP----WL---
Cp_AF443619         AQ--------------------PSSAAAIRPPSHHQRPA-------AGMNS----WAAMI
Ps_ABK24536         SASA------------------PPDSNAKGLHGHGHGYG-------HGPTP----WPTLA
Pt_XVI.516          TTTTSS----SGTTTTTTTTNPSTTTTTSTTSSKP-----------LSLPAK-PRLFPLS
Pt_VI.1202          TTTT--------------TTNPSTSTTTSKT---------------LSLPAK-PRLFPSS
Pt_ABK95369         TTSTST----AAATTTTATPTATAATTTTTTNNQNNTADPTSKTTGLSLGSTRPRFYPFS
Mt_DW016069_ps      TNPCN------------------NQTNTNKS------------------------RFSNA
At5g06710           TSAAQ------------------PSTSAAHN---------------LCLSTS-----SLI
Os04g4635012004     NTNNN----------------SSAAAAADRRGIRT-----------TTAAGGGSVVDTAA
Gm_06MC31751        ---------------------GSAVNGAGGSPKTS-----------FSMAPKPHFFNPFA
Os_Q84U86           TAGAPHQPNHQQCHPKSNTTISSSSTAAAAVAVAGGNVLPSHCQFFPAAAAAADRTSQST
Ta_ABC86568         STSS-----ASACDVPN-----FSTNAGMGMPMPSPVALPDHRQFFCGYRDTG--ATYGG
Os06g04850          ---------------------------NAGVPSPAAAIFPGHPQFLCGFRDHAGAASSSY
```

FIGURE 12 (continued)

```
Os10g41230          AQRSSA-------------
Os_CAA65456         AQRSSA-------------
Zm_07MC27159        ARRP---------------
Pt_40.143           VHQRTFDAPASRS------
Pt_II.1260          IHHRTFDAPASSS------
Pt_286586           -------------------
At3g60390           LRQRPAAGSH---------
At2g44910           LQQKSGR------------
Sl_TA56840          ASKTLDVQRSQM-------
Le_THOM             ASKTLDVQRSQM-------
Pt_29.72            PVTRGPTPFDAIRPRS---
At4g16780           RISHGLT-FDALRPRS---
Sl_BAD27255         VP---IRSFDAIHPRS---
Sl_TA49906          H----PRS-----------
Pb_CAA64221         AG---HRSFDAVPH-----
Gm_Q39862           QILDSRKQNDKIEKKDRKP
At5g47370           GQVAHGLNFEALRPRS---
At4g17460           -QMAHGSTFDVMRPRS---
Cp_AF443619         SP-----RPS---------
Ps_ABK24536         SAHLRPIRPPPRLEQ----
Pt_XVI.516          HGQVQPHHAAS--------
Pt_VI.1202          HGQVQAHQAAS--------
Pt_ABK95369         HTQTHHHQHTA--------
Mt_DW016069_ps      QAQAQAHQISS--------
At5g06710           PVKPRPAKQVS--------
Os04g4635012004     DGGILCHRPIAVRPQQS--
Gm_06MC31751        NPSAAC-------------
Os_Q84U86           ---WNAAAPLVTRELF---
Ta_ABC86568         ---FSGLAKVVKPAR----
Os06g04850          GGASSGLAKAVRAAR----
```

FIGURE 12 (continued)

```
                                             1                                                50
          A_thaliana_AT2G27990_1_1     (1)   ----------------------------------------------MDMI
                        TMxxx6639      (1)   ----------------------------------------------MDMI
             P_trichocarpa_558279_1    (1)   METRSFRPESHVAQQSRRDKLRGQ-QSLTSVQYLDDYPNSLERISVSPGL
       P_trichocarpa_scaff_IX_1539_1   (1)   METRSFRPESHVAQQSRRDKLRGQ-QSLTSVQYLDDYPNSLERISVSPGL
       P_trichocarpa_scaff_IX_1538_1   (1)   --------------------------------------------------
      V_vinifera_GSVIVT00024567001_1   (1)   MEMRNFRPESHVAQQSRRDKLRVQHQSSTPAHHLEEFPNSLEQLSVHPEL
              G_gnemon_AJ318871_1      (1)   --------------------------------------------------
    O_sativa_indica_BGIOSIBCE012511_1  (1)   --------------------------------------------------
         O_sativa_LOC_Os03g47730_1_1   (1)   --------------------------------------------------
            O_sativa_Os03g0680700_1    (1)   --------------------------------------------------
               S_bicolor_5257689_1     (1)   --------------------------------------------------
              Z_mays_TA211699_4577_1   (1)   --------------------------------------------------
      V_vinifera_GSVIVT00018398001_1   (1)   --------------------------------------------------
               M.truncatula_BHID2      (1)   --------------------------------------------------
      V_vinifera_GSVIVT00021404001_1   (1)   --------------------------------------------------
    O_sativa_indica_BGIOSIBCE019267_1  (1)   --------------------------------------------------
         O_sativa_LOC_Os05g38120_1_1   (1)   --------------------------------------------------
            O_sativa_Os05g0455200_1    (1)   --------------------------------------------------
            O_sativa_TA55403_4530_1    (1)   --------------------------------------------------
               S_bicolor_5289797_1     (1)   --------------------------------------------------
Z_mays_ZM07MC19826_BFb0096N05_19776_1  (1)   --------------------------------------------------
               S_bicolor_5266102_1     (1)   --------------------------------------------------
    O_sativa_indica_BGIOSIBCE004273_1  (1)   --------------------------------------------------
         O_sativa_LOC_Os01g62920_1_1   (1)   --------------------------------------------------
            O_sativa_Os01g0848400_1    (1)   --------------------------------------------------
            O_sativa_TA50671_4530_1    (1)   --------------------------------------------------
                        TMxxx5170      (1)   --------------------------------------------------
                        Consensus      (1)
```

FIGURE 14

```
                                                  51                                               100
             A_thaliana_AT2G27990_1_1       (5)  KPDFQQIRRDKFRVEQMNDFPNTWTQQQHQNIRIPNNLDLIGILQNQISV
                           TMxxx6639        (5)  KPDFQQIRRDKFRVEQMNDFPNTWTQQQHQNIRIPNNLDLIGILQNQISV
                 P_trichocarpa_558279_1    (50)  SPDLVHVRNNRNDNTIYDSTMFSSEILNFATSSHVLSAPKVSIVDQELGA
         P_trichocarpa_scaff_IX_1539_1     (50)  SPDLVHVRNNRNDNTIYDSTMFSSEILNFATSSHVLSAPKVSIVDQELGA
         P_trichocarpa_scaff_IX_1538_1      (1)  ------------------------------------------MVDQELGP
         V_vinifera_GSVIVT00024567001_1    (51)  NPDLIQVRNVRNGNVLYDPIVLSSEMLNFSSNSHVFLGSKDAMVGQDS--
                   G_gnemon_AJ318871_1      (1)  ------------------MPLYDASMIPGSEMFNFSAEAELLSFQSKNLS
    O_sativa_indica_BGIOSIBCE012511_1      (1)  --------------------------------------------------
            O_sativa_LOC_Os03g47730_1_1     (1)  --------------------------------------------------
                O_sativa_Os03g0680700_1     (1)  --------------------------------------------------
                    S_bicolor_5257689_1     (1)  --------------------------------------------------
                  Z_mays_TA211699_4577_1    (1)  --------------------------------------------------
         V_vinifera_GSVIVT00018398001_1     (1)  --------------------------------------------------
                    M.truncatula_BHID2      (1)  --------------------------------------------------
         V_vinifera_GSVIVT00021404001_1     (1)  --------------------------------------------------
    O_sativa_indica_BGIOSIBCE019267_1      (1)  --------------------------------------------------
            O_sativa_LOC_Os05g38120_1_1     (1)  --------------------------------------------------
                O_sativa_Os05g0455200_1     (1)  --------------------------------------------------
                O_sativa_TA55403_4530_1     (1)  --------------------------------------------------
                    S_bicolor_5289797_1     (1)  --------------------------------------------------
Z_mays_ZM07MC19826_BFb0096N05_19776_1      (1)  --------------------------------------------------
                    S_bicolor_5266102_1     (1)  --------------------------------------------------
    O_sativa_indica_BGIOSIBCE004273_1      (1)  --------------------------------------------------
            O_sativa_LOC_Os01g62920_1_1     (1)  --------------------------------------------------
                O_sativa_Os01g0848400_1     (1)  --------------------------------------------------
                O_sativa_TA50671_4530_1     (1)  --------------------------------------------------
                           TMxxx5170        (1)  --------------------------------------------------
                           Consensus       (51)
```

FIGURE 14 (continued)

```
                                                  101                                              150
A_thaliana_AT2G27990_1_1                   (55)   PVQTDLYQDSAATFMNMP------------QSIHRDPQGPSNWRISDLSQ
TMxxx6639                                  (55)   PVQTDLYQDSAATFMNMP------------QSIHRDPQGPSNWRISDLSQ
P_trichocarpa_558279_1                    (100)   VPLNRPILAEDSSFTGMTSHPVLSNFNASHKASSCDPQGCGNWRSLDSQQ
P_trichocarpa_scaff_IX_1539_1             (100)   VPLNRPILAEDSSFTGMTSHPVLSNFNASHKASSCDPQGCGNWRSLDSQQ
P_trichocarpa_scaff_IX_1538_1               (9)   AHLHSPIAADDSSFTNMP-HPVLSNLNASPTASNGDAQGCGNWTKLGSEQ
V_vinifera_GSVIVT00024567001_1             (99)   -----NAVSQDASFPNLS--------HPISSKAAGDPQNCDNWKGLGTQQ
G_gnemon_AJ318871_1                        (33)   SQQSASSEDAVSCRPVAAGPFTSFGHTVSKDSVVSNVTSWKNYSAQGSEE
O_sativa_indica_BGIOSIBCE012511_1           (1)   --------------------------------------------------
O_sativa_LOC_Os03g47730_1_1                 (1)   --------------------------------------------------
O_sativa_Os03g0680700_1                     (1)   --------------------------------------------------
S_bicolor_5257689_1                         (1)   --------------------------------------------------
Z_mays_TA211699_4577_1                      (1)   --------------------------------------------------
V_vinifera_GSVIVT00018398001_1              (1)   --------------------------------------------------
M.truncatula_BHID2                          (1)   ------------------------------------------MAEEGFEN
V_vinifera_GSVIVT00021404001_1              (1)   -------------------------------------------MADGFEP
O_sativa_indica_BGIOSIBCE019267_1           (1)   ------------------------------MSSAAGGGGGYGGGGGEHQH
O_sativa_LOC_Os05g38120_1_1                 (1)   ------------------------------MSSAAGGGGGYGGGGGEHQH
O_sativa_Os05g0455200_1                     (1)   ------------------------------MSSAAGGGGGYGGGGGEHQH
O_sativa_TA55403_4530_1                     (1)   ------------------------------MSSAAGGGGGYGGGGGEHQH
S_bicolor_5289797_1                         (1)   ------------------------------MSSAAGGGGYGAGGGAEHQH
Z_mays_ZM07MC19826_BFb0096N05_19776_1       (1)   ------------------------------MSSAAGGG-YGAAGGAEHQH
S_bicolor_5266102_1                         (1)   ------------------------------MSSAAGG--YGGGAGSGAEP
O_sativa_indica_BGIOSIBCE004273_1           (1)   ------------------------------MSSAAGGGGYGGGQGGGAEH
O_sativa_LOC_Os01g62920_1_1                 (1)   ------------------------------MSSAAGGGGYGGGQGGGAEH
O_sativa_Os01g0848400_1                     (1)   ------------------------------MSSAAGGGGYGGGQGGGAEH
O_sativa_TA50671_4530_1                     (1)   ------------------------------MSSAAGGGGYGGGQGGGAEH
TMxxx5170                                   (1)   ------------------------------MSSAAGGGGYGGGQGGGAEH
Consensus                                 (101)                                  SSAA   G     G
```

FIGURE 14 (continued)

```
                                                     151                                              200
                A_thaliana_AT2G27990_1_1      (93)  --PSTVNHGYDQAGIRPNNVADLLSDHFSSR---------NQILDRPLYV
                             TMxxx6639      (93)  --PSTVNHGYDQAGIRPNNVADLLSDHFSSR---------NQILDRPLYV
                 P_trichocarpa_558279_1     (150)  SYDLMVNYAGGSVGGERNQKPMFVGEVLSNN-ARVSNISTSRQYLMPGYN
            P_trichocarpa_scaff_IX_1539_1     (150)  SYDLMVNYAGGSVGGERNQKPMFVGEVLSNN-ARVSNISTSRQYLMPGYN
            P_trichocarpa_scaff_IX_1538_1      (58)  GYDLTVDYTGGSVVGERNQKLMSAVEVLSNN-ARVTDISTYTQYFKPSYN
           V_vinifera_GSVIVT00024567001_1     (136)  SCDWIVNYANGTVASESNQNPMYVGEVLSASSMKVNNISASSLDLKPNYS
                    G_gnemon_AJ318871_1      (83)  WPGRVILNSVGYEGGQDSLATPLMLGGSVKEVAAQADAMRLYLMNPGYDA
        O_sativa_indica_BGIOSIBCE012511_1       (1)  --------------------------------------------------
            O_sativa_LOC_Os03g47730_1_1       (1)  --------------------------------------------------
               O_sativa_Os03g0680700_1       (1)  --------------------------------------------------
                  S_bicolor_5257689_1       (1)  --------------------------------------------------
                  Z_mays_TA211699_4577_1       (1)  --------------------------------------------------
           V_vinifera_GSVIVT00018398001_1       (1)  ------------------------------------MADSHQPFRLPQQS
                     M.truncatula_BHID2       (9)  Y------------------------------------------YHIPQQS
           V_vinifera_GSVIVT00021404001_1       (8)  -------------------------------------------YHVPQQS
        O_sativa_indica_BGIOSIBCE019267_1      (21)  QQQ----------H-HH--LLLG-------Q-------AAGQLYHVPQHS
            O_sativa_LOC_Os05g38120_1_1      (21)  QQQ----------Q-HH--LLLG-------Q-------AAGQLYHVPQHS
               O_sativa_Os05g0455200_1      (21)  QQQ----------Q-HH--LLLG-------Q-------AAGQLYHVPQHS
               O_sativa_TA55403_4530_1      (21)  QQQ----------Q-HH--LLLG-------Q-------AAGQLYHVPQHS
                  S_bicolor_5289797_1      (21)  -------------------LLLG-------Q-------AAGQLYHVPQHS
   Z_mays_ZM07MC19826_BFb0096N05_19776_1      (20)  -------------------LLLG-------Q-------ASGQLYHVPQHS
                  S_bicolor_5266102_1      (19)  HCHGHGHG-DFMLHHHAQHIA------------------AQQLYHVPQHS
        O_sativa_indica_BGIOSIBCE004273_1      (21)  HHHHHGHAGHLLLHHHPQHVAGAAVAAAAAA-------AGGQMYHVPQHS
            O_sativa_LOC_Os01g62920_1_1      (21)  HHHHHGHAGHLLLHHHPQHVAGAAVAAAAAA-------AGGQMYHVPQHS
               O_sativa_Os01g0848400_1      (21)  HHHHHGHAGHLLLHHHPQHVAGAAVAAAAAA-------AGGQMYHVPQHS
               O_sativa_TA50671_4530_1      (21)  HHHHHGHAGHLLLHHHPQHVAGAAVAAAAAA-------AGGQMYHVPQHS
                             TMxxx5170      (21)  HHHHHGHAGHLLLHHHPQHVAGAAVAAAAAA-------AGGQMYHVPQHS
                             Consensus     (151)                     V                  A  QLYHVPQHS
```

FIGURE 14 (continued)

```
                                           201                                                 250
            A_thaliana_AT2G27990_1_1     (132) GRDSIPQSSMIRR--SEVSCLDDNQ-----------------KGCVTVAC
                         TMxxx6639     (132) GRDSIPQSSMIRR--SEVSCLDDNQ-----------------KGCVTVAC
              P_trichocarpa_558279_1     (199) GNQNVQLPSTLRNTFGEISSEDSIKQLRVMQVPSLPPYQNAAQDVIPSGC
        P_trichocarpa_scaff_IX_1539_1    (199) GNQNVQLPSTLRNTFGEISSEDSIKQLRVMQVPSLPPYQNAAQDVIPSGC
        P_trichocarpa_scaff_IX_1538_1    (107) EYRDFELQSSLADPSDEFSSQDNQKQLRERQFTTHPLHQNTLQDVVTSGL
       V_vinifera_GSVIVT00024567001_1    (186) GYQ--DVQSSITNPSSEISSQDSQKHYGEIHFNSPQLYRNTLQEVVTSAA
                G_gnemon_AJ318871_1      (133) YSEASTAAHSSNNIANQIHDVHKQIVEVPAHFQSYIQNHAVSVVGETSHS
   O_sativa_indica_BGIOSIBCE012511_1       (1) ---------------------------------MVASKQ-----LHSQRC
         O_sativa_LOC_Os03g47730_1_1       (1) ---------------------------------MVASKQ-----LHSQRC
             O_sativa_Os03g0680700_1       (1) ---------------------------------MVASKQ-----LHSQRC
                 S_bicolor_5257689_1       (1) ----------------------------------MAKQQ-----QHDKGS
              Z_mays_TA211699_4577_1       (1) ---------------------------------MVMAKQ-----HHDKGL
       V_vinifera_GSVIVT00018398001_1     (15) KRENPRLFLQNNHPQLFSTFQHAPVHQLHCPDQNPNAGFVN--SEGVHV
                  M.truncatula_BHID2      (17) RREKLRYLSQNQTSFIE----SS-----PTLNPSFSPLPS----LYDPSL
       V_vinifera_GSVIVT00021404001_1     (15) RRDKLRVVAQNHSGCVE----AA-----TNLHGCAGLLP-----LYDPSL
   O_sativa_indica_BGIOSIBCE019267_1      (44) RREKLRFPPDHPAESPP-----------PPPPGSWPLPP-----AFYSYA
         O_sativa_LOC_Os05g38120_1_1      (44) RREKLRFPPDHPAESPP-----------PPPPGSWPLPP-----AFYSYA
             O_sativa_Os05g0455200_1      (44) RREKLRFPPDHPAESPP-----------PPPPGSWPLPP-----AFYSYA
            O_sativa_TA55403_4530_1       (44) RREKLRFPPDHPAESPP-----------PPPPGSWPLPP-----AFYSYA
                 S_bicolor_5289797_1      (38) RREKLRFPPDPADS---------------PPPTAWPAPP-----PFYSYA
Z_mays_ZM07MC19826_BFb0096N05_19776_1    (37) RREKLRFPPDPADS---------------PPPTAWPAPP-----PFYSYA
                 S_bicolor_5266102_1      (50) RREKLRFPPD--DSPP---HASASAPQQQHAGVAWPPPPPP--PAFYSYA
   O_sativa_indica_BGIOSIBCE004273_1      (64) RREKLRFPPDAGDSPPPHGHGHGHAPQQQQQHGSWPPPP-----AFYSYA
         O_sativa_LOC_Os01g62920_1_1      (64) RREKLRFPPDAGDSPPPHGHGHGHAPQQQQQHGSWPPPP-----AFYSYA
             O_sativa_Os01g0848400_1      (64) RREKLRFPPDAGDSPPPHGHGHGHAPQQQQQHGSWPPPP-----AFYSYA
            O_sativa_TA50671_4530_1       (64) RREKLRFPPDAGDSPPPHGHGHGHAPQQQQQHGSWPPPP-----AFYSYA
                         TMxxx5170      (64) RREKLRFPPDAGDSPPPHGHGHGHAPQQQQQHGSWPPPP-----AFYSYA
                         Consensus     (201) RREKLR P                         SWP  P      F SYA
```

FIGURE 14 (continued)

```
                                          251                                              300
A_thaliana_AT2G27990_1_1           (163) SG-------------------------TGNEILRSSYDQGSSSGSYR---
TMxxx6639                          (163) SG-------------------------TGNEILRSSYDQGSSSGSYR---
P_trichocarpa_558279_1             (249) FRP-----------------------RMNERILHPSFVTESTASHFDNN-
P_trichocarpa_scaff_IX_1539_1      (249) FRP-----------------------RMNERILHPSFVTESTASHFDNN-
P_trichocarpa_scaff_IX_1538_1      (157) VG------------------------RTREIILHPSFENQSSTLHFN-D-
V_vinifera_GSVIVT00024567001_1     (234) VGTQGLEMASFAHQNIRDTGRDSWEDGGNELVLLPNFGNQSSALRLD-S-
G_gnemon_AJ318871_1                (183) SGSQ-------------------WVSGTNELALLPSYSDIQNGHYLPSSR
O_sativa_indica_BGIOSIBCE012511_1   (13) GGHY-----------------------CQLHHHRPEEIAGAGAERHRRD-
O_sativa_LOC_Os03g47730_1_1         (13) GGHY-----------------------CQLHHHRPEEIAGAGAESHRRD-
O_sativa_Os03g0680700_1             (13) GGHY-----------------------CQLHHHRPEEIAGAGAESHRRD-
S_bicolor_5257689_1                 (12) PKQA-----------------------RNEPAPPPQPAPFRLEHCCHCD-
Z_mays_TA211699_4577_1              (13) PKQA-----------------------RNE------PAPFRLEQCCRCD-
V_vinifera_GSVIVT00018398001_1      (63) VGP------------------------SSASFSFPSCGDHSLSSIHNAK-
M.truncatula_BHID2                  (54) ISP------------------------LDAINSNPFLYQMNHVYNHGG--
V_vinifera_GSVIVT00021404001_1      (51) LPS------------------------DLLTCASASAHEFQHHSHPLSG-
O_sativa_indica_BGIOSIBCE019267_1   (78) SSS------------------------SSYSPHSPT-LAHSQLVAHGMP-
O_sativa_LOC_Os05g38120_1_1         (78) SSS------------------------SSYSPHSPT-LAHAQLVAHGMP-
O_sativa_Os05g0455200_1             (78) SSS------------------------SSYSPHSPT-LAHAQLVAHGMP-
O_sativa_TA55403_4530_1             (78) SSS------------------------SSYSPHSPT-LAHAQLVAHGMP-
S_bicolor_5289797_1                 (68) SSST-----------------------SSYSPHSPTPLAHAQLVAHALP-
Z_mays_ZM07MC19826_BFb0096N05_19776_1 (67) SSST-----------------------SSYSPHSPT-LAHTQLVAHALP-
S_bicolor_5266102_1                 (93) SSST-----------------------SSYSPHSPTLAQAQLVVAHGLA-
O_sativa_indica_BGIOSIBCE004273_1  (109) SSS------------------------SSYSPHSPTLAQAQL-VAHGLA-
O_sativa_LOC_Os01g62920_1_1        (109) SSS------------------------SSYSPHSPTLAQAQL-VAHGLA-
O_sativa_Os01g0848400_1            (109) SSS------------------------SSYSPHSPTLAQAQL-VAHGLA-
O_sativa_TA50671_4530_1            (109) SSS------------------------SSYSPHSPTLAQAQL-VAHGLA-
TMxxx5170                          (109) SSS------------------------SSYSPHSPTLAQAQL-VAHGLA-
Consensus                          (251) S S                        S  S H PT    S  VAH
```

FIGURE 14 (continued)

```
                                            301                                              350
A_thaliana_AT2G27990_1_1                (185) -----------------------G-EFSFLPSLENQSVAHNASNWNHGPV
TMxxx6639                               (185) -----------------------G-EFSFLPSLENQSVAHKASNWNHGPV
P_trichocarpa_558279_1                  (275) -------GSTWMSRPLENYHHWSTGELGLVERTSDQEMMTITSDANTQGL
P_trichocarpa_scaff_IX_1539_1           (275) -------GSTWMSRPLENYHHWSTGELGLVERTSDQEMMTITSDANTQGL
P_trichocarpa_scaff_IX_1538_1           (181) -------PNAWIRRPNENSHQWSC-ELGLITRKSSQELRTIPNDANTQGL
V_vinifera_GSVIVT00024567001_1          (282) -------SVAWMTRPVEGCHQWSGGDLGVLANKSLGDLSTIASDSNAQGL
G_gnemon_AJ318871_1                     (214) YYGIGSWANRHNALQDSYQGAFVEGKVGVEVRPQQLSIGRDGCGPSGQGL
O_sativa_indica_BGIOSIBCE012511_1        (39) -------GS-------------------------------------SGCG
O_sativa_LOC_Os03g47730_1_1              (39) -------GS-------------------------------------SGCG
O_sativa_Os03g0680700_1                  (39) -------GS-------------------------------------SGCG
S_bicolor_5257689_1                      (38) -------GA-------------------------------------HGQA
Z_mays_TA211699_4577_1                   (33) -------DA-------------------------------------HRQA
V_vinifera_GSVIVT00018398001_1           (88) -------DLDHR------------------------------FSFGADAV
M.truncatula_BHID2                       (78) ----------------------------------SNSNNNEVMLLKSEPL
V_vinifera_GSVIVT00021404001_1           (76) -------SAEACKANPGCVVKEEGVNLMGYVDFDQSFNGGEMVVFKPEPL
O_sativa_indica_BGIOSIBCE019267_1       (102) -------PGAAT---------------------------SGGAQIPSQNF
O_sativa_LOC_Os05g38120_1_1             (102) -------PGAAT---------------------------SGGAQIPSQNF
O_sativa_Os05g0455200_1                 (102) -------PGAAT---------------------------SGGAQIPSQNF
O_sativa_TA55403_4530_1                 (102) -------PGAAT---------------------------SGGAQIPSQNF
S_bicolor_5289797_1                      (94) -------AGAG-------------------------------AQIPSQNF
Z_mays_ZM07MC19826_BFb0096N05_19776_1    (92) -------AGAG-------------------------------AQIPSQNF
S_bicolor_5266102_1                     (119) -------PPPL------------------------------SSQIPTQNF
O_sativa_indica_BGIOSIBCE004273_1       (133) -------PP--------------------------------LPQIPTQNF
O_sativa_LOC_Os01g62920_1_1             (133) -------PP--------------------------------LPQIPTQNF
O_sativa_Os01g0848400_1                 (133) -------PP--------------------------------LPQIPTQNF
O_sativa_TA50671_4530_1                 (133) -------PP--------------------------------LPQIPTQNF
TMxxx5170                               (133) -------PP--------------------------------LPQIPTQNF
Consensus                               (301)                                            Q  SQN
```

FIGURE 14 (continued)

```
                                             351                                              400
A_thaliana_AT2G27990_1_1                (211) NVTATSHTN-------------------------------SKKGFPLS--
TMxxx6639                               (211) NVTATSHTN-------------------------------SKKGFPLS--
P_trichocarpa_558279_1                  (318) SLSLSSINPPSKVEVTHFGEEYASEHLQLKVADRVSQESHQDSKFSKSSS
P_trichocarpa_scaff_IX_1539_1           (318) SLSLSSINPPSKVEVTHFGEEYASEHLQLKVADRVSQESHQDSKFSKSSS
P_trichocarpa_scaff_IX_1538_1           (223) SLSLSSNQS-SKVNETRFGEAYESECLQSKNG--LSKEPHHVSKVSKASY
V_vinifera_GSVIVT00024567001_1          (325) SLSLSSHPS-SKIQVAQFGERYESKDLRSGTA---AFSCPQDLKVMSSGY
G_gnemon_AJ318871_1                     (264) SLSLSPHQP------------------SEVPLHQIDAVCNRTNILQLSAD
O_sativa_indica_BGIOSIBCE012511_1        (45) GAGPMVV-------------------------------------------
O_sativa_LOC_Os03g47730_1_1              (45) GAGPMVV-------------------------------------------
O_sativa_Os03g0680700_1                  (45) GAGPMVV-------------------------------------------
S_bicolor_5257689_1                      (44) DDG-----------------------------------------------
Z_mays_TA211699_4577_1                   (39) DDESMDA-------------------------------------------
V_vinifera_GSVIVT00018398001_1          (101) SLSLAPHHR-----------------------------------------
M.truncatula_BHID2                       (94) SLSLSSN-------------------------------------------
V_vinifera_GSVIVT00021404001_1          (119) SLTHHEYGS-----------------------A---------------IF
O_sativa_indica_BGIOSIBCE019267_1       (118) ALSLSSA-------------------------------------------
O_sativa_LOC_Os05g38120_1_1             (118) ALSLSSA-------------------------------------------
O_sativa_Os05g0455200_1                 (118) ALSLSSA-------------------------------------------
O_sativa_TA55403_4530_1                 (118) ALSLSSA-------------------------------------------
S_bicolor_5289797_1                     (106) ALSLSSA-------------------------------------------
Z_mays_ZM07MC19826_BFb0096N05_19776_1   (104) ALSLSSA-------------------------------------------
S_bicolor_5266102_1                     (132) ALSLSSS-------------------------------------------
O_sativa_indica_BGIOSIBCE004273_1       (144) SLSLSSA-------------------------------------------
O_sativa_LOC_Os01g62920_1_1             (144) SLSLSSA-------------------------------------------
O_sativa_Os01g0848400_1                 (144) SLSLSSA-------------------------------------------
O_sativa_TA50671_4530_1                 (144) SLSLSSA-------------------------------------------
TMxxx5170                               (144) SLSLSSA-------------------------------------------
Consensus                               (351) SLSLSS
```

FIGURE 14 (continued)

```
                                                   401                                              450
A_thaliana_AT2G27990_1_1                   (228)  LLSDIPP---SRDVGN--------------AAVLSTMN----IHGPLGPF
TMxxx6639                                  (228)  LLSDIPP---SRDVGN--------------AAVLSTMN----IHGPLGPF
P_trichocarpa_558279_1                     (368)  LCALPKPSIITKSCGKSI------------HDIVGTSTHALRNTGPLGPF
P_trichocarpa_scaff_IX_1539_1              (368)  LCALPKPSIITKSCGKSI------------HDIVGTSTHALRNTGPLGPF
P_trichocarpa_scaff_IX_1538_1              (270)  MCPLPRPSILSKGCGKSL------------HDLPGDATNILRNAGPLGPF
V_vinifera_GSVIVT00024567001_1             (371)  LCSDSKPPVSGKGYGNSL------------HDIVGTSTYTHRSAGPLGPF
G_gnemon_AJ318871_1                        (296)  QLKGKSEDVQSRNEGAHGPQGHPSPYSRRVLSRVGAPMDLQMNVGPLGPF
O_sativa_indica_BGIOSIBCE012511_1           (52)  LTLGSGAAAAEDNGGGRS------------RCCCGAGG----AAP-----
O_sativa_LOC_Os03g47730_1_1                 (52)  LTLGSGAAAAEDDGGGRS------------RCCCGAGG----AAP-----
O_sativa_Os03g0680700_1                     (52)  LTLGSGAAAAEDDGGGRS------------RCCCGAGG----AAP-----
S_bicolor_5257689_1                         (47)  PNGAGPLHLTLGPAADRR-R----------RCSCGVAP----APA----A
Z_mays_TA211699_4577_1                      (46)  AGSAGPLHLTLGPLGSAAGP----------RCSCGVAP----APAPALAA
V_vinifera_GSVIVT00018398001_1             (110)  HQRCAPLELNAKRYDVVSVR----------GGTPKPNNE-LRSSVPLGPF
M.truncatula_BHID2                         (101)  --KNNQNQMSAANFQRYG-------------SVVDVSR----NTVPLGPF
V_vinifera_GSVIVT00021404001_1             (131)  SDKVTGGYMVPGIVGGSGS------------TSNDVSR----SSVPLGPF
O_sativa_indica_BGIOSIBCE019267_1          (125)  --SSNPPPTPRRQFGGGG----------------GG------AAGPYGPF
O_sativa_LOC_Os05g38120_1_1                (125)  --SSNPPPTPRRQFGGGG----------------GGGG----AAGPYGPF
O_sativa_Os05g0455200_1                    (125)  --SSNPPPTPRRQFGGGG----------------GGGG----AAGPYGPF
O_sativa_TA55403_4530_1                    (125)  --SSNPPPTPRRQFGGGG----------------GGGG----AAGPYGPF
S_bicolor_5289797_1                        (113)  --SSNPPPAPRRQLAAG------------------V------ATGPYGPF
Z_mays_ZM07MC19826_BFb0096N05_19776_1      (111)  --SSNPPPAPRRQLAAG------------------V------AAGPYGPF
S_bicolor_5266102_1                        (139)  --SSNPPP--APPPQQRR----------------AHAA----PSAPFGPF
O_sativa_indica_BGIOSIBCE004273_1          (151)  --SSNPPPPQAQPRRQLG----------------GLAQ----ATGPFGPF
O_sativa_LOC_Os01g62920_1_1                (151)  --SSNPPPPQAQPRRQLG----------------GLAQ----ATGPFGPF
O_sativa_Os01g0848400_1                    (151)  --SSNPPPPQAQPRRQLG----------------GLAQ----ATGPFGPF
O_sativa_TA50671_4530_1                    (151)  --SSNPPPPQAQPRRQLG----------------GLAQ----ATGPFGPF
TMxxx5170                                  (151)  --SSNPPPPQAQPRRQLG----------------GLAQ----ATGPFGPF
Consensus                                  (401)    SS PP    R  G                   G A     A GP GPF
```

FIGURE 14 (continued)

```
                                            451                                              500
A_thaliana_AT2G27990_1_1               (257) TGYASILKSSRFLEPAQKMLEEFCISYASKIISRSESTS-----------
TMxxx6639                              (257) TGYASILKSSRFLEPAQKMLEGFCISYASKIISRSESTS-----------
P_trichocarpa_558279_1                 (406) TGYATILKSSKFLKPAQQLLEEFSSRTGPKLTRIFEMS--------EDQV
P_trichocarpa_scaff_IX_1539_1          (406) TGYATILKSSKFLKPAQQLLEEFSSRTGPKLTRIFEMS--------EDQV
P_trichocarpa_scaff_IX_1538_1          (308) TGYATILSSSRFLKPAQELMDEFCGVKGLGLIRTSELPK-----RIGGEA
V_vinifera_GSVIVT00024567001_1         (409) TGYATILKSSKFLKPAQQVLDEFCKAASPKLVKTCEVTR-----------
G_gnemon_AJ318871_1                    (346) TGYATILKGSKYLKPAQQLLEEFCNVGKGLNYQCNPSKQKLLGHHLSAEK
O_sativa_indica_BGIOSIBCE012511_1       (81) ATMVSPLRGSRYLLPAQELLREAVSAAAASARGGDDDDE-----A-----
O_sativa_LOC_Os03g47730_1_1             (81) ATMVSALRGSRYLLPAQELLREAVSAAAASARGGDDDDE-----A-----
O_sativa_Os03g0680700_1                 (81) ATMVSALRGSRYLLPAQELLREAVSAAAASARGGDDDDE-----A-----
S_bicolor_5257689_1                     (78) PVTVAVLRGSRYLRPAQELLGDVVRVADLAAGDDEDEDQ-----A-----
Z_mays_TA211699_4577_1                  (82) PATVAVLRGSRYMRPAQELLGEVVRVADLAAADDEDEDQ-----A-----
V_vinifera_GSVIVT00018398001_1         (149) TGYASILKRSSFLSPAQQLLDDFCGVGRGVSDSASFDPP-----LE----
M.truncatula_BHID2                     (132) TGYASVLKGSRFLKPAQQLLDEICDVG-VRAEKIIADAD-----A-----
V_vinifera_GSVIVT00021404001_1         (165) TGYASILKGSRFLKPAQQLLEEFCDVG-CGLYAERVSAD-----S-----
O_sativa_indica_BGIOSIBCE019267_1      (151) TGYAAVLGRSRFLGPAQKLLEEICDVGGRPAQLDRGSDE-----G-----
O_sativa_LOC_Os05g38120_1_1            (153) TGYAAVLGRSRFLGPAQKLLEEICDVGGRPAQLDRGSDE-----G-----
O_sativa_Os05g0455200_1                (153) TGYAAVLGRSRFLGPAQKLLEEICDVGGRPAQLDRGSDE-----G-----
O_sativa_TA55403_4530_1                (153) TGYAAVLGRSRFLGPAQKLLEEICDVGGRPAQLDRGSDE-----G-----
S_bicolor_5289797_1                    (137) TGYAAVLGRSRFLGPAQKLLEEICDVGGRPPHLDRRSDE-----G-----
Z_mays_ZM07MC19826_BFb0096N05_19776_1  (135) TGYAAVLGRSRFLGPAQKLLEEICDVGGRPPHLDRRSDD-----------
S_bicolor_5266102_1                    (165) TGYAAVLGRSRFLGPAEKLLEEICDVGGAASHVDRSVSD-----E-----
O_sativa_indica_BGIOSIBCE004273_1      (179) TGYAAVLGRSRFLGPAEKLFEEICDVGGAASHVDRTISD-----E-----
O_sativa_LOC_Os01g62920_1_1            (179) TGYAAVLGRSRFLGPAEKLFEEICDVGGAASHVDRTISD-----E-----
O_sativa_Os01g0848400_1                (179) TGYAAVLGRSRFLGPAEKLFEEICDVGGAASHVDRTISD-----E-----
O_sativa_TA50671_4530_1                (179) TGYAAVLGRSRFLGPAEKLFEEICDVGGAASHVDRTISD-----E-----
TMxxx5170                              (179) TGYAAVLGRSRFLGPAEKLFEEICDVGGAASHVDRTISD-----E-----
Consensus                              (451) TGYAAVLK SRFL PAQKLLEEICDVGG  A  D    D
```

FIGURE 14 (continued)

```
                                                 501                                                550
A_thaliana_AT2G27990_1_1                 (296) ------------MEDDDDDDDNLSGFSSSS-------------EPLE---
TMxxx6639                                (296) ------------MEDDDDDDDNLSGFSSSS-------------EPLE---
P_trichocarpa_558279_1                   (448) TAPALADIVNEANENSGTNAKNYSGIPSSTFYCSNKASGGDDVGGSGGSC
P_trichocarpa_scaff_IX_1539_1            (448) TAPALADIVNEANENSGTNAKNYSGIPSSTFYCSNKASGGDDVGGSGGSC
P_trichocarpa_scaff_IX_1538_1            (353) SPPALGDSVNEADTGDEANDDNNLGASPFTSRRSNEEIGHCGVGNS--SS
V_vinifera_GSVIVT00024567001_1           (448) ------------RTS---GDGGNSAVSSSTFYDSN-EISEGGVKSS--SC
G_gnemon_AJ318871_1                      (396) SLPDAVIPPISTTVKGEVDGRKASACAASSSMSVVDKTSSEPAMGEQLVI
O_sativa_indica_BGIOSIBCE012511_1        (121) ----------V---ASFPHDGK-----------------STGIGGGGG--
O_sativa_LOC_Os03g47730_1_1              (121) ----------V---ASFPHDGK-----------------STGIGGGGGG-
O_sativa_Os03g0680700_1                  (121) ----------V---ASFPHDGK-----------------STGIGGGGGG-
S_bicolor_5257689_1                      (118) ----------D---ADRLEGGGRHRSLRRA---------AG---NDGDG-
Z_mays_TA211699_4577_1                   (122) --------------TERLEGGG-HRAARRA---------AGKAGNDGDG-
V_vinifera_GSVIVT00018398001_1           (190) ----------------------------------------GSGTAEDPIG
M.truncatula_BHID2                       (171) ----------SLMETNHVIGGMINGVDDED---------TLGGDGRKN--
V_vinifera_GSVIVT00021404001_1           (204) ----------SMMDPPMESLSGTGIVDDPL---------SCGDGGEHRR-
O_sativa_indica_BGIOSIBCE019267_1        (191) -----------LLDVDAMEAAGS--VDHEM---------DGSDRAVADAV
O_sativa_LOC_Os05g38120_1_1              (193) -----------LLDVDAMDAAGS--VDHEM---------DGSDRAVADAV
O_sativa_Os05g0455200_1                  (193) -----------LLDVDAMDAAGS--VDHEM---------DGSDRAVADAV
O_sativa_TA55403_4530_1                  (193) -----------LLDVDAMDAAGS--VDHEM---------DGSDRAVADAV
S_bicolor_5289797_1                      (177) -----------MLDMDAMDVVGD--VDHDM---------DGGDRATAEAV
Z_mays_ZM07MC19826_BFb0096N05_19776_1    (174) ------------EGMLDMDAAGG--VDHEM---------DGGDCATAEAV
S_bicolor_5266102_1                      (205) ----------GVLDADPME---A--IDHDM---------DGADRAASDAG
O_sativa_indica_BGIOSIBCE004273_1        (219) ----------GLLDADPMDGVDHDVVDHDL---------GGADRAAADAG
O_sativa_LOC_Os01g62920_1_1              (219) ----------GLLDADPMDGVDHDVVDHDL---------GGADRAAADAG
O_sativa_Os01g0848400_1                  (219) ----------GLLDADPMDGVDHDVVDHDL---------GGADRAAADAG
O_sativa_TA50671_4530_1                  (219) ----------GLLDADPMDGVDHDVVDHDL---------GGADRAAADAG
TMxxx5170                                (219) ----------GLLDADPMDGVDHDVVDHDL---------GGADRAAADAG
Consensus                                (501)             LD D MDG     VD              GG  A ADA
```

FIGURE 14 (continued)

```
                                           551                                              600
A_thaliana_AT2G27990_1_1            (318)  ----PKNRLKKAKLLFLQEE-----------------------VCKWYKL
TMxxx6639                           (318)  ----PKNRLKKAKLLFLQEE-----------------------VCKWYKL
P_trichocarpa_558279_1              (498)  GSYGPEYQQKKAKLLFLQEE-----------------------VCRRYKQ
P_trichocarpa_scaff_IX_1539_1       (498)  GSYGPEYQQKKAKLLFLQEE-----------------------VCRRYKQ
P_trichocarpa_scaff_IX_1538_1       (401)  KPYMPEYQQMKAKLLYLQDE-----------------------VLRRYKQ
V_vinifera_GSVIVT00024567001_1      (480)  ESYRPDYQQKKAKLLFMQEE-----------------------VCRRYKQ
G_gnemon_AJ318871_1                 (446)  SGARFEMHKKRTRLLALLDE-----------------------LQRRYRQ
O_sativa_indica_BGIOSIBCE012511_1   (139)  ---------VQAKLLSLLSELE----------------------SRHE-H
O_sativa_LOC_Os03g47730_1_1         (140)  ---------VQAKLLSLLSELE----------------------SRHE-H
O_sativa_Os03g0680700_1             (140)  ---------VQAKLLSLLSELE----------------------SRHE-H
S_bicolor_5257689_1                 (142)  ---------VQDKLLGLLSELE----------------------SRRE-R
Z_mays_TA211699_4577_1              (147)  ---------VQAKLLYLLSELE----------------------SRRE-R
V_vinifera_GSVIVT00018398001_1      (200)  CSHGSEHFWKSSRLAPMLDE-----------------------VYRRYKL
M.truncatula_BHID2                  (200)  ----------KSRLLTVLDE-----------------------VCRRYRQ
V_vinifera_GSVIVT00021404001_1      (234)  ---------KKSRLISMLDE-----------------------VYRRYKH
O_sativa_indica_BGIOSIBCE019267_1   (219)  TVSGAEQQWRKTRLISLMEDFKALLSSLLKLAGGDPQFIYNQKVCKRYRQ
O_sativa_LOC_Os05g38120_1_1         (221)  TVSGAEQQWRKTRLISLMED-----------------------VCKRYRQ
O_sativa_Os05g0455200_1             (221)  TVSGAEQQWRKTRLISLMED-----------------------VCKRYRQ
O_sativa_TA55403_4530_1             (221)  TVSGAEQQWRKTRLISLMED-----------------------VCKRYRQ
S_bicolor_5289797_1                 (205)  AVSGAEQQWRKTRLISLMED-----------------------VCRRYKQ
Z_mays_ZM07MC19826_BFb0096N05_19776_1 (201)  AVSGAEQQWRKTRLISLMDD-----------------------VCRRYKQ
S_bicolor_5266102_1                 (231)  PISGAEQQWKKTRLISMMEE-----------------------VCKRYRL
O_sativa_indica_BGIOSIBCE004273_1   (250)  PISGAEQQWKKTKLISMMEE-----------------------VCKRYRQ
O_sativa_LOC_Os01g62920_1_1         (250)  PISGAEQQWKKTKLISMMEE-----------------------VCKRYRQ
O_sativa_Os01g0848400_1             (250)  PISGAEQQWKKTKLISMMEE-----------------------VCKRYRQ
O_sativa_TA50671_4530_1             (250)  PISGAEQQWKKTKLISMMEE-----------------------VCKRYRQ
TMxxx5170                           (250)  PISGAEQQWKKTKLISMMEE-----------------------VCKRYRQ
Consensus                           (551)     G EQQ KKTKLISLMEE                       VCRRYRQ
```

FIGURE 14 (continued)

```
                                                601                                               650
          A_thaliana_AT2G27990_1_1      (341) YNHQLQTVMSSFNTVAGLNTATPYISLALKRTSRSFKALRTAIAEHVKQI
                        TMxxx6639       (341) YNHQLQTVMSSFNTVAGLNTATPYISLALKRTSRSFKALRTAIAEHVKQI
            P_trichocarpa_558279_1      (525) YHQQMQMVASSFESVASLSAATPYVSLALKTVSSNFRSLKHGISDQLKLV
     P_trichocarpa_scaff_IX_1539_1      (525) YHQQMQMVASSFESVASLSAATPYVSLALKTVSSNFRSLKHGISDQLKLV
     P_trichocarpa_scaff_IX_1538_1      (428) YHQQMEMVASFFESVAGLSAATQYISMAVKAVSGNFRSIKHCISDQLKHV
      V_vinifera_GSVIVT00024567001_1    (507) YHQQMQMVVSSFETVAGLSAATPYIALALKTVSRHFRFLKNAISDQLRHI
              G_gnemon_AJ318871_1       (473) YNDQMQMIITSFESVGGLGAAAPYTSLALKAMSRHFKCLKDAIGDQLKVI
   O_sativa_indica_BGIOSIBCE012511_1    (157) YFGELRRVSASFEPALGAGATAGYTALMAQAMSRHFGSLRRAILRKLRLH
       O_sativa_LOC_Os03g47730_1_1      (158) YFGELRRVSASFEPALGAGATAGYTALMAQAMSHHFGSLRRAILRKLRLH
          O_sativa_Os03g0680700_1       (158) YFGELRRVSASFEPALGAGATAGYTALMAQAMSHHFGSLRRAILRKLRLH
             S_bicolor_5257689_1        (160) YFGELGRVVSSFEPALGDGAAAAYTSLMARAMARHFGNLRRAILRRLRLH
            Z_mays_TA211699_4577_1      (165) YFGELERVVSSFEPALGGGAAAAYTTLMARAMGRHFGNLRRAILRRLRLQ
      V_vinifera_GSVIVT00018398001_1    (227) YCQQMHSVVASFETVAGLQNAAPYISFAFKAMSNHFRYLKNAILDQIQFT
              M.truncatula_BHID2        (217) YYQQIHAVITSFEYVAGLGNAAPYASLAINAMSKHFRFLKNVITDQLQFI
      V_vinifera_GSVIVT00021404001_1    (252) YYQQMQAVVASFESVAGLGNAAPYADLALKAMSKHFRCLKNAITDQLQFT
   O_sativa_indica_BGIOSIBCE019267_1    (269) YYQQLQAVVSSFETVAGLSNAAPFASMALRTMSKHFKYLKGIILNQLRNT
       O_sativa_LOC_Os05g38120_1_1      (248) YYQQLQAVVSSFETVAGLSNAAPFASMALRTMSKHFKYLKGIILNQLRNT
          O_sativa_Os05g0455200_1       (248) YYQQLQAVVSSFETVAGLSNAAPFASMALRTMSKHFKYLKGIILNQLRNT
          O_sativa_TA55403_4530_1       (248) YYQQLQAVVSSFETVAGLSNAAPFASMALRTMSKHFKYLKGIILNQLRNT
             S_bicolor_5289797_1        (232) YYQQLQSVISSFETVAGLSNAAPFASMALRTMSKHFKCLKEMIMSQLRNT
Z_mays_ZM07MC19826_BFb0096N05_19776_1   (228) YYQQLQSVISSFETVAGLSNAAPFAFMALRTMSKHFKCLKGMVMSQLRNT
             S_bicolor_5266102_1        (258) YYQQVQTVINSFETVAGFSNAAPFAAMALRAMAKHFKCLKSMILSQLRNT
   O_sativa_indica_BGIOSIBCE004273_1    (277) YYQQVQAVMASFETVAGFSNAAPFAALALRAMAKHFKCLKSMILNQLRNT
       O_sativa_LOC_Os01g62920_1_1      (277) YYQQVQAVMASFETVAGFSNAAPFAALALRAMAKHFKCLKSMILNQLRNT
          O_sativa_Os01g0848400_1       (277) YYQQVQAVMASFETVAGFSNAAPFAALALRAMAKHFKCLKSMILNQLRNT
          O_sativa_TA50671_4530_1       (277) YYQQVQAVMASFETVAGFSNAAPFAALALRAMAKHFKCLKSMILNQLRNT
                        TMxxx5170       (277) YYQQVQAVMASFETVAGFSNAAPFAALALRAMAKHFKCLKSMILNQLRNT
                        Consensus       (601) YYQQLQAVVSSFETVAGLSNAAPYASLALRAMSKHFK LK  IL QLRNT
```

FIGURE 14 (continued)

```
                                                651                                               700
A_thaliana_AT2G27990_1_1                 (391) SSHSSNGNN--------------NNRFQKR-------------------Q
TMxxx6639                                (391) SSHSSNGNN--------------NNRFQKR-------------------Q
P_trichocarpa_558279_1                   (575) TKALGDDLF--------------SRNTVAVGSKGDTITSRSIYMDQSIQK
P_trichocarpa_scaff_IX_1539_1            (575) TKALGDDLF--------------SRNTVAVGSKGDTITSRSIYMDQSIQK
P_trichocarpa_scaff_IX_1538_1            (478) TKALGENLF--------------SPNTFGSRTAG-SLR----YKDQSFQK
V_vinifera_GSVIVT00024567001_1           (557) RKALGEDFA--------------GDASSPR--------------LNFPKH
G_gnemon_AJ318871_1                      (523) SKALGNESS---------LPGVSVGETPRLRLVDQGIR------------
O_sativa_indica_BGIOSIBCE012511_1        (207) AAAAAR---TRSALLRLVRD-AMEEDDEGDGEEEEEVV----------NR
O_sativa_LOC_Os03g47730_1_1              (208) AAAAAR---TRSALLRLARD-AMEEDDEGDGEEEEEVV----------NR
O_sativa_Os03g0680700_1                  (208) AAAAAR---TRSALLRLARD-AMEEDDEGDGEEEEEVV----------NR
S_bicolor_5257689_1                      (210) AAAAARRSLRRGVEAGDHDH-DEDEDEDGDEEVTEELV----------ER
Z_mays_TA211699_4577_1                   (215) AAAAARRSLRRGGE--DQDD-DDDDDGDSDGEVTEELV----------DR
V_vinifera_GSVIVT00018398001_1           (277) GKALVGHNIG-------------KDETPRVWTADQG--------------
M.truncatula_BHID2                       (267) G-KSNYHIS------------NRKDESPRFHNGDGAPY----------SQ
V_vinifera_GSVIVT00021404001_1           (302) N-KAHGQIS------------HGKDESPRFGNTDRGLY----------GQ
O_sativa_indica_BGIOSIBCE019267_1        (319) G-KGATKDG------------LGKEDTANFGLMGGG-------------A
O_sativa_LOC_Os05g38120_1_1              (298) G-KGATKDG------------LGKEDTTNFGLMGGG-------------A
O_sativa_Os05g0455200_1                  (298) G-KGATKDG------------LGKEDTTNFGLMGGG-------------A
O_sativa_TA55403_4530_1                  (298) G-KGATKDG------------LGKEDTTNFGLMGGG-------------A
S_bicolor_5289797_1                      (282) S-KVVANDG------------IGKDDMANFALMGGG-------------A
Z_mays_ZM07MC19826_BFb0096N05_19776_1    (278) S-KVIANHG-----------IIAKDDMANFALMGGG-------------A
S_bicolor_5266102_1                      (308) K-VAAGKEG-------------LSKDIVMFGLAGGS------------AA
O_sativa_indica_BGIOSIBCE004273_1        (327) SNKVAVKDG-------------LNKEIAVFGLAGGSSG----------GA
O_sativa_LOC_Os01g62920_1_1              (327) SNKVAVKDG-------------LNKEIAVFGLAGGSSG----------GA
O_sativa_Os01g0848400_1                  (327) SNKVAVKDG-------------LNKEIAVFGLAGGSSG----------GA
O_sativa_TA50671_4530_1                  (327) SNKVAVKDG-------------LNKEIAVFGLAGGSSG----------GA
TMxxx5170                                (327) SNKVAVKDG-------------LNKEIAVFGLAGGSSG----------GA
Consensus                                (651) S   A                   ED   FG  G
```

FIGURE 14 (continued)

```
                                             701                                               750
A_thaliana_AT2G27990_1_1             (408) RSLIGNNVGFESQQQHIWRPQRGLPERAVAVLRAWLFDHFLHPYPTDSDK
TMxxx6639                            (408) RSLIGNNVGFESQQQHIWRPQRGLPERAVAALRAWLFDHFLHPYPTDSDK
P_trichocarpa_558279_1               (611) NKSGGVSVGYHEPQQHIWRPQRGLPERSVAILRAWLFEHFLHPYPTDTDK
P_trichocarpa_scaff_IX_1539_1        (611) NKSGGVSVGYHEPQQHIWRPQRGLPERSVAILRAWLFEHFLHPYPTDTDK
P_trichocarpa_scaff_IX_1538_1        (509) NNSGGPNVGYLEPQEHIWRPQRGLPERAVVILRAWLFEHFLHPYPTDTDK
V_vinifera_GSVIVT00024567001_1       (579) K-PGGANLGFLEPQQHVWRPQRGLPERAVAILRAWLFEHFLHPYPTDTDK
G_gnemon_AJ318871_1                  (552) --NQRSVHHLGMLEQHAWRPQRGLPERAVSVLRAWLFEHFLHPYPTDADK
O_sativa_indica_BGIOSIBCE012511_1    (243) VVRRTKQAAAARAEQA-WRPLRGLPEDAVGVLRAWLFDHFLHPYPNDNEK
O_sativa_LOC_Os03g47730_1_1          (244) VVRRTKQAAAARAEQA-WRPLRGLPEDAVGVLRAWLFDHFLHPYPNDNEK
O_sativa_Os03g0680700_1              (244) VVRRTKQAAAARAEQA-WRPLRGLPEDAVGVLRAWLFDHFLHPYPNDNEK
S_bicolor_5257689_1                  (249) VARRTKLAAAARAEQASWRPLRGLPDGSVAVLRAWLFDHFLHPYPDDGEK
Z_mays_TA211699_4577_1               (252) LARRTKLAAAARAEQA-WRPLRGLPDGSVAVLRAWLFDHFLHPYPNDGEK
V_vinifera_GSVIVT00018398001_1       (300) FHSQKAVQSSMFLQHPIWRSQRGLPDHAVAVLRAWLFEHFLHPYPTDLEK
M.truncatula_BHID2                   (294) ----SPGFMEHVQ-QPVWRPQRGLPERAVSVFRGWLFEHFLHPYPSDTDK
V_vinifera_GSVIVT00021404001_1       (329) RPMHSSGFLEH---QPVWRPQRGLPERAVTVLRAWLFEHFLHPYPTDTDK
O_sativa_indica_BGIOSIBCE019267_1    (343) GLLRGNNVNSFSQPHNIWRPQRGLPERAVSVLRAWLFEHFLHPYPTDSDK
O_sativa_LOC_Os05g38120_1_1          (322) GLLRGNNVNSFSQPHNIWRPQRGLPERAVSVLRAWLFEHFLHPYPTDSDK
O_sativa_Os05g0455200_1              (322) GLLRGNNVNSFSQPHNIWRPQRGLPERAVSVLRAWLFEHFLHPYPTDSDK
O_sativa_TA55403_4530_1              (322) GLLRGNNVNSFSQPHNIWRPQRGLPERAVSVLRAWLFEHFLHPYPTDSDK
S_bicolor_5289797_1                  (306) GLLRGNNVNAFGQPHNIWRPQRGLPERAVSVLRSWLFEHFLHPYPTDSDK
Z_mays_ZM07MC19826_BFb0096N05_19776_1 (303) GLLRGNSVNAFSQPHNIWRPQRGLPERAVSVLRSWLFEHFLHPYPTDSDK
S_bicolor_5266102_1                  (332) ALQRASSMAAFGQPHNIWRPQRGLPERAVSVLRAWLFEHFLHPYPTDGDK
O_sativa_indica_BGIOSIBCE004273_1    (354) GLQRANSASAFGQPHNIWRPQRGLPERAVSVLRAWLFEHFLHPYPTDGDK
O_sativa_LOC_Os01g62920_1_1          (354) GLQRANSASAFGQPHNIWRPQRGLPERAVSVLRAWLFEHFLHPYPTDGDK
O_sativa_Os01g0848400_1              (354) GLQRANSASAFGQPHNIWRPQRGLPERAVSVLRAWLFEHFLHPYPTDGDK
O_sativa_TA50671_4530_1              (354) GLQRANSASAFGQPHNIWRPQRGLPERAVSVLRAWLFEHFLHPYPTDGDK
TMxxx5170                            (354) GLQRANSASAFGQPHNIWRPQRGLPERAVSVLRAWLFEHFLHPYPTDGDK
Consensus                            (701)  L RG    A  Q    IWRPQRGLPERAVSVLRAWLFEHFLHPYPTDSDK
```

FIGURE 14 (continued)

```
                                           751                                              800
A_thaliana_AT2G27990_1_1             (458) QMLATQTGLSRNQVSNWFINARVRLWKPMVEEIHTLETKAIKNAD-----
TMxxx6639                            (458) QMLATQTGLSRNQVSNWFINARVRLWKPMVEEIHTLETKAIKNAD-----
P_trichocarpa_558279_1               (661) HMLATRTGLSRNQVSNWFINARVRVWKPMVEEIHMLETKGLAEIS---GK
P_trichocarpa_scaff_IX_1539_1        (661) HMLATRTGLSRNQVSNWFINARVRVWKPMVEEIHMLETKGLAEIS---GK
P_trichocarpa_scaff_IX_1538_1        (559) HMLATQTGLSRYQVSNWFINARVRLWKPMVEEIHTLETKGLLENNRSSGK
V_vinifera_GSVIVT00024567001_1       (628) HMLATQTGLSRNQVSNWFINARVRVWKPMVEEVHMLETKGLAERDQNSGK
G_gnemon_AJ318871_1                  (600) HMLARQTGLSRSQVSNWFINARVGLWKPMVEEMYELETREASQVDAPPGK
O_sativa_indica_BGIOSIBCE012511_1    (292) LMLAVATGLSRTQISNWFINARVRLWKPMVEEMYNDEFDDDDAGSGGGGA
O_sativa_LOC_Os03g47730_1_1          (293) LMLAVATGLSRTQISNWFINARVRLWKPMVEEMYNDEFDDDDAGSGGGGA
O_sativa_Os03g0680700_1              (293) LMLAVATGLSRTQISNWFINARVRLWKPMVEEMYNDEFDDDDAGSGGGGA
S_bicolor_5257689_1                  (299) LRLAVTTGLSRRQISNWFINARVRLWKPMIEEMYQDEFTEGSAVSRDDDA
Z_mays_TA211699_4577_1               (301) LRLAVTTGLSRRQISNWFINARVRLWKPMIEEMYKDEFSDGSAVSSYDDA
V_vinifera_GSVIVT00018398001_1       (350) QILAQRTSLSRNQVSNWFINARVRLWKPMVEEILTLETKQAQMAAEGEAN
M.truncatula_BHID2                   (339) LMLAKQTGLSRNQVSNWFINARVRLWKPMVEEIHMLESQQSP------KE
V_vinifera_GSVIVT00021404001_1       (376) LMLAKQTGLSRNQVSNWFINARVRLWKPMVEEIHTLETRQAQ------KS
O_sativa_indica_BGIOSIBCE019267_1    (393) QMLAKQTGLTRNQVSNWFINARVRLWKPMVEEIHNLEMRQLK-NPSLDKN
O_sativa_LOC_Os05g38120_1_1          (372) QMLAKQTGLTRNQVSNWFINARVRLWKPMVEEIHNLEMRQLQKNPSLDKN
O_sativa_Os05g0455200_1              (372) QMLAKQTGLTRNQVSNWFINARVRLWKPMVEEIHNLEMRQLQKNPSLDKN
O_sativa_TA55403_4530_1              (372) QMLAKQTGLTRNQVSNWFINARVRLWKPMVEEIHNLEMRQLQKNPSLDKN
S_bicolor_5289797_1                  (356) QMLAKQTGLTRNQVSNWFINARVRLWKPMVEEIHNLEMRQVQKNTSVDKN
Z_mays_ZM07MC19826_BFb0096N05_19776_1 (353) QMLAKQTGLTRNQVSNWFINARVRLWKPMVEEIHNLEMRQLHKTTSVDQN
S_bicolor_5266102_1                  (382) QMLAKQTGLTRNQVSNWFINARVRLWKPMVEEIHNLEMRQVHKHPVLDKG
O_sativa_indica_BGIOSIBCE004273_1    (404) QMLAKQTGLTRNQVSNWFINARVRLWKPMVEEIHNLEMRQMHKHSVVDKG
O_sativa_LOC_Os01g62920_1_1          (404) QMLAKQTGLTRNQVSNWFINARVRLWKPMVEEIHNLEMRQMHKHSVVDKG
O_sativa_Os01g0848400_1              (404) QMLAKQTGLTRNQVSNWFINARVRLWKPMVEEIHNLEMRQMHKHSVVDKG
O_sativa_TA50671_4530_1              (404) QMLAKQTGLTRNQVSNWFINARVRLWKPMVEEIHNLEMRQMHKHSVVDKG
TMxxx5170                            (404) QMLAKQTGLTRNQVSNWFINARVRLWKPMVEEIHNLEMRQMHKHSVVDKG
onsensus                             (751) QMLAKQTGLSRNQVSNWFINARVRLWKPMVEEIHNLE RQL   S  D
```

FIGURE 14 (continued)

```
                                             801                                               850
A_thaliana_AT2G27990_1_1               (503) -----------------------------TSHNIEPSNRPNTVSSPSHEQ
TMxxx6639                              (503) -----------------------------TSHNIEPSNRPNTVSSPSHEQ
P_trichocarpa_558279_1                 (708) NDGNSPEGNI------------------QSN-DEQTSNKLGKNSMLNKQL
P_trichocarpa_scaff_IX_1539_1          (708) NDGNSPEGNI------------------QSN-DEQTSNKLGKNSMLNKQL
P_trichocarpa_scaff_IX_1538_1          (609) NGGNSAEGAS------------------QPDGDHRASKELGTSYMPSKQL
V_vinifera_GSVIVT00024567001_1         (678) KDWKSIGEGV------------------SQRDGNQPSNKPSVNAMSDEQL
G_gnemon_AJ318871_1                    (650) TDREERDTSKGGISTEKNASGRGKVLMETISEMQSVSGCGSSSKLEQTTS
O_sativa_indica_BGIOSIBCE012511_1      (342) SSSS----------------------------------------------
O_sativa_LOC_Os03g47730_1_1            (343) SSSS----------------------------------------------
O_sativa_Os03g0680700_1                (343) SSSS----------------------------------------------
S_bicolor_5257689_1                    (349) SASSSS--------------------------------------------
Z_mays_TA211699_4577_1                 (351) SASGASSSS-----------------------------------------
V_vinifera_GSVIVT00018398001_1         (400) KPTDPLPSAN------------------PLPLRKPFQNTPTQKMEDTQSK
M.truncatula_BHID2                     (383) SQRDEHSRNN------------------LSENN-----------IAENPS
V_vinifera_GSVIVT00021404001_1         (420) SQREERSADR------------------QSDHLPS----A-NSLVFENPS
O_sativa_indica_BGIOSIBCE019267_1      (442) QLSMQH-TQH------------------SSDSSGK-PCDPSNSLQGQSSS
O_sativa_LOC_Os05g38120_1_1            (422) QLSMQH-TQH------------------SSDSSGK-PCDPSNSLQGQSSS
O_sativa_Os05g0455200_1                (422) QLSMQH-TQH------------------SSDSSGK-PCDPSNSLQGQSSS
O_sativa_TA55403_4530_1                (422) QLSMQH-TQH------------------SSDSSGK-PCDPSNSLQGQSSS
S_bicolor_5289797_1                    (406) QLGMQQ-IQH------------------STDSSGK-LSDPSNSQRGQSSG
Z_mays_ZM07MC19826_BFb0096N05_19776_1  (403) QLGMQQQNHH------------------SSDGSGRPSSDPSNSQRGQSSG
S_bicolor_5266102_1                    (432) QHVLHHQTQH------------------SSESSGK-PSDPSDSHLGQSSS
O_sativa_indica_BGIOSIBCE004273_1      (454) QHSVHHQAQH------------------SSQCSGN-PSVPSDSHPGQSSS
O_sativa_LOC_Os01g62920_1_1            (454) QHSVHHQAQH------------------SSQCSGN-PSVPSDSHPGQSSS
O_sativa_Os01g0848400_1                (454) QHSVHHQAQH------------------SSQCSGN-PSVPSDSHPGQSSS
O_sativa_TA50671_4530_1                (454) QHSVHHQAQH------------------SSQCSGN-PSVPSDSHPGQSSS
TMxxx5170                              (454) QHSVHHQAQH------------------SSQCSGN-PSVPSDSHPGQSSS
Consensus                              (801) Q S     Q                   SS          PS S   Q S
```

FIGURE 14 (continued)

```
                                           851                                              900
A_thaliana_AT2G27990_1_1            (524) TLTG----------------LSGTKR---SRLEYMDMVGFNR--------
TMxxx6639                           (524) TLTG----------------LSGTKR---SRLEYMDMVGFNR--------
P_trichocarpa_558279_1              (739) ECSG-IGSSGSSGEQLDEEQWSEGKR---SRVEFQVPTTMDGSLMNFLPY
P_trichocarpa_scaff_IX_1539_1       (739) ECSG-IGSSGSSGEQLDEEQWSEGKR---SRVEFQVPTTMDGSLMNFLPY
P_trichocarpa_scaff_IX_1538_1       (641) ECSSNIGSSGGSRDQLDAEHWNQEKR---SRVESQAPIHADRSLMNFMLY
V_vinifera_GSVIVT00024567001_1      (710) ECRG-MCPSAGTGDELGAEQWNQEKR---SRVECQIPGSMDGSLMGFVPY
G_gnemon_AJ318871_1                 (700) TSQNGHENCGTSVSIPLESSYLHAHEADAARETAVNVNRHFSGQTQGMPT
O_sativa_indica_BGIOSIBCE012511_1   (346) --------------------------------------------------
O_sativa_LOC_Os03g47730_1_1         (347) --------------------------------------------------
O_sativa_Os03g0680700_1             (347) --------------------------------------------------
S_bicolor_5257689_1                 (355) --------------------------------------------------
Z_mays_TA211699_4577_1              (360) --------------------------------------------------
V_vinifera_GSVIVT00018398001_1      (432) RSRN--------K-----LSYMFEQRDEQTNFPYNNFSSNYQMGVSGIEK
M.truncatula_BHID2                  (404) TSTDKFIDVAYKRTRNELHNMSVP------NHSIASNQQVGNVGVSMMNN
V_vinifera_GSVIVT00021404001_1      (447) TSAQRVQDAPSKRTRNELSEVHVGSE-EPMNLSYNNLSAHPHVGVGVSTA
O_sativa_indica_BGIOSIBCE019267_1   (472) MTRNHSISASRHIED-GLSQMPHDIS-GQVSFAYNGLA-AHHSIAMAHHH
O_sativa_LOC_Os05g38120_1_1         (452) MTRNHSISASRHIED-GLSQMPHDIS-GQVSFAYNGLA-AHHSIAMAHHH
O_sativa_Os05g0455200_1             (452) MTRNHSISASRHIED-GLSQMPHDIS-GQVSFAYNGLA-AHHSIAMAHHH
O_sativa_TA55403_4530_1             (452) MTRNHSISASRHIED-GLSQMPHDIS-GQVSFAYNGLA-AHHSIAMAHHH
S_bicolor_5289797_1                 (436) MTRNLSSPASRHIQD-ELSQMPHDMP-GQVSFAYNGLP-THHGLALSHPQ
Z_mays_ZM07MC19826_BFb0096N05_19776_1 (435) MTRNLSSRAPRHIQDDELSQMPHDMA-GQVSFAYSGLPPAHHGLALSHHH
S_bicolor_5266102_1                 (463) LTRNHNIPASQGFAD-ELSEMSHSIQQGQVTFAYNGLSTAHHSLASSQHH
O_sativa_indica_BGIOSIBCE004273_1   (485) ITRNHNTAASQGFPD-ELSQMSQSIQ-GQVSFAYNGLTSQHNIASPHHQH
O_sativa_LOC_Os01g62920_1_1         (485) ITRNHNTAASQGFPD-ELSQMSQSIQ-GQVSFAYNGLTSQHNIASPHHQH
O_sativa_Os01g0848400_1             (485) ITRNHNTAASQGFPD-ELSQMSQSIQ-GQVSFAYNGLTSQHNIASPHHQH
O_sativa_TA50671_4530_1             (485) ITRNHNTAASQGFPD-ELSQMSQSIQ-GQVSFAYNGLTSQHNIASPHHQH
TMxxx5170                           (485) ITRNHNTAASQGFPD-ELSQMSQSIQ-GQVSFAYNGLTSQHNIASPHHQH
Consensus                           (851)  TRN    A        LSQM            AYN L             H
```

FIGURE 14 (continued)

```
                                           901                                                950
              A_thaliana_AT2G27990_1_1    (547) --------------------GNVSLTLELRRGVDNVI-------------
                            TMxxx6639    (547) --------------------GNVSLTLELRRGVDNVI-------------
                 P_trichocarpa_558279_1    (785) QRSG----------IDNG--GAVSLTLGLRQGIESAQ-------------
          P_trichocarpa_scaff_IX_1539_1    (785) QRSG----------IDNG--GAVSLTLGLRQGIESAQ-------------
          P_trichocarpa_scaff_IX_1538_1    (688) QKPG----------SENGGLGAVSLTLGLRHGAENAQ-------------
         V_vinifera_GSVIVT00024567001_1    (756) QRSG----------VEIGGLGAVSLTLGLRHSVETAQQ------------
                  G_gnemon_AJ318871_1    (750) SHSAISGVESDSGYADSSGFSYEQATKRLRQGLGNTIDFSSYMGGRISHE
      O_sativa_indica_BGIOSIBCE012511_1    (346) --------------------------------------------------
            O_sativa_LOC_Os03g47730_1_1    (347) --------------------------------------------------
                O_sativa_Os03g0680700_1    (347) --------------------------------------------------
                    S_bicolor_5257689_1    (355) --------------------------------------------------
                  Z_mays_TA211699_4577_1    (360) --------------------------------------------------
         V_vinifera_GSVIVT00018398001_1    (469) SASKG-----------------ISLALGLHQNNR----------------
                  M.truncatula_BHID2    (448) G-----------ATSNG-----VSLTLGLHQNH-------GIGLSEPFNM
         V_vinifera_GSVIVT00021404001_1    (496) G-----------GSSN------VSLTLGLHQNN-------GIGLSESFPI
      O_sativa_indica_BGIOSIBCE019267_1    (519) Q-----PDLIGTGGAANA--GGVSLTLGLHQNNN--RAYIAEPLPAALPL
            O_sativa_LOC_Os05g38120_1_1    (499) Q-----PDLIGTGGAANA--GGVSLTLGLHQNNN--RAYIAEPLPAALPL
                O_sativa_Os05g0455200_1    (499) Q-----PDLIGTGGAANA--GGVSLTLGLHQNNN--RAYIAEPLPAALPL
                O_sativa_TA55403_4530_1    (499) Q-----PDLIGTGGAANA--GGVSLTLGLHQNNN--RAYIAEPLPAALPL
                    S_bicolor_5289797_1    (483) Q-AEAVSAGIGLGGVAAG-GGGVSLTLGLHQNN---RTYIAEPLPAALPL
Z_mays_ZM07MC19826_BFb0096N05_19776_1    (484) HPQQAQAEAVGVGGVAASSGGGVSLTLGLHQNNNNNRAYIAEPLPAALPL
                    S_bicolor_5266102_1    (512) QQAGP------MSGIGGAGNGGVSLTLGLHQNN---RVCIAEPLPESLPP
      O_sativa_indica_BGIOSIBCE004273_1    (533) QQVG-------GVGIGGS-NGGVSLTLGLHQNN---RVCIAEPLPAALPA
            O_sativa_LOC_Os01g62920_1_1    (533) QQVG-------GVGIGGG-NGGVSLTLGLHQNN---RVCIAEPLPAALPA
                O_sativa_Os01g0848400_1    (533) QQVG-------GVGIGGG-NGGVSLTLGLHQNN---RVCIAEPLPAALPA
                O_sativa_TA50671_4530_1    (533) QQVG-------GVGIGGG-NGGVSLTLGLHQNN---RVCIAEPLPAALPA
                            TMxxx5170    (533) QQVG-------GVGIGGG-NGGVSLTLGLHQNN---RVCIAEPLPAALPA
                            Consensus    (901) Q                G  GGVSLTLGLHQNN       A  L
```

FIGURE 14 (continued)

```
                                          951                                              1000
A_thaliana_AT2G27990_1_1               (564) -----------QTQTQDHQ---------------------FGTGSQMFHD
TMxxx6639                              (564) -----------QTQTQDHQ---------------------FGTGSQMFHD
P_trichocarpa_558279_1                 (810) -----------HQIQLQQHNGQF-----------K-----QSFGGQMIHD
P_trichocarpa_scaff_IX_1539_1          (810) -----------HQIQLQQHNGQF-----------K-----QSFGGQMIHD
P_trichocarpa_scaff_IX_1538_1          (715) -----------HEQLQQ---------------------------------
V_vinifera_GSVIVT00024567001_1         (784) -Q--------QHQQQLQQQEDQL-----------R-----RQFGGQMIHD
G_gnemon_AJ318871_1                    (800) SLNPRPTGNASVSLTLGLRHSGAQEKYTGALYLPREDTLQGCNSRYEIHE
O_sativa_indica_BGIOSIBCE012511_1      (346) --------------------------------------------------
O_sativa_LOC_Os03g47730_1_1            (347) --------------------------------------------------
O_sativa_Os03g0680700_1                (347) --------------------------------------------------
S_bicolor_5257689_1                    (355) --------------------------------------------------
Z_mays_TA211699_4577_1                 (360) --------------------------------------------------
V_vinifera_GSVIVT00018398001_1         (486) -I--------ESSTSFFQPGNK----------------------------
M.truncatula_BHID2                     (475) SA--------AQRFGLAHQPDS--YAASGFQLQNRQFGRDFIG-GQLLRD
V_vinifera_GSVIVT00021404001_1         (522) NA--------AQRFGLGLDANSEGYVIGGFEAQNRHFGRDVIG-GQLLHD
O_sativa_indica_BGIOSIBCE019267_1      (560) NL--------AHRFGLEDVSDAY-VMSSFGG-QDRHFTKEIGG--HLLHD
O_sativa_LOC_Os05g38120_1_1            (540) NL--------AHRFGLEDVSDAY-VMSSFGG-QDRHFTKEIGG--HLLHD
O_sativa_Os05g0455200_1                (540) NL--------AHRFGLEDVSDAY-VMSSFGG-QDRHFTKEIGG--HLLHD
O_sativa_TA55403_4530_1                (540) NL--------AHRFGLEDVSDAY-VMSSFGG-QDRHFTKEIGG--HLLHD
S_bicolor_5289797_1                    (528) NL--------PHRFGLEDVSDAY-VMGSFGGGQDRHFTKGIGG-HHLLHD
Z_mays_ZM07MC19826_BFb0096N05_19776_1  (534) SL--------PHRFGLEDVSDAY-VMGPFGG-QDRHFSKGIGGGHNLLHD
S_bicolor_5266102_1                    (553) NL--------AHRFGLEEVSDPY-MMGSFGN-QDRHFGKEMGG--HLVHD
O_sativa_indica_BGIOSIBCE004273_1      (572) NL--------AHRFGLEEVSDAY-VMSSFGG-QDRHFGKEIGG--HLLHD
O_sativa_LOC_Os01g62920_1_1            (572) NL--------AHRFGLEEVSDAY-VMSSFGG-QDRHFGKEIGG--HLLHD
O_sativa_Os01g0848400_1                (572) NL--------AHRFGLEEVSDAY-VMSSFGG-QDRHFGKEIGG--HLLHD
O_sativa_TA50671_4530_1                (572) NL--------AHRFGLEEVSDAY-VMSSFGG-QDRHFGKEIGG--HLLHD
TMxxx5170                              (572) NL--------AHRFGLEEVSDAY-VMSSFGG-QDRHFGKEIGG--HLLHD
Consensus                              (951)  L         HRFGLE   D Y         Q R F K  GG   LLHD
```

FIGURE 14 (continued)

```
                                              1001                          1031
A_thaliana_AT2G27990_1_1              (582)  FVG----------------------------
TMxxx6639                             (582)  FVG----------------------------
P_trichocarpa_558279_1                (833)  FVG----------------------------
P_trichocarpa_scaff_IX_1539_1         (833)  FVG----------------------------
P_trichocarpa_scaff_IX_1538_1         (721)  -------------------------------
V_vinifera_GSVIVT00024567001_1        (809)  FVG----------------------------
G_gnemon_AJ318871_1                   (850)  IHDGHNQACVGGFETHDIQFRKHLIGTQLLQ
O_sativa_indica_BGIOSIBCE012511_1     (346)  -------------------------------
O_sativa_LOC_Os03g47730_1_1           (347)  -------------------------------
O_sativa_Os03g0680700_1               (347)  -------------------------------
S_bicolor_5257689_1                   (355)  -------------------------------
Z_mays_TA211699_4577_1                (360)  -------------------------------
V_vinifera_GSVIVT00018398001_1        (499)  -------------------------------
M.truncatula_BHID2                    (514)  YVG----------------------------
V_vinifera_GSVIVT00021404001_1        (563)  FVG----------------------------
O_sativa_indica_BGIOSIBCE019267_1     (598)  FVG----------------------------
O_sativa_LOC_Os05g38120_1_1           (578)  FVG----------------------------
O_sativa_Os05g0455200_1               (578)  FVG----------------------------
O_sativa_TA55403_4530_1               (578)  FVG----------------------------
S_bicolor_5289797_1                   (568)  FVG----------------------------
Z_mays_ZM07MC19826_BFb0096N05_19776_1 (574)  FVG----------------------------
S_bicolor_5266102_1                   (591)  FVG----------------------------
O_sativa_indica_BGIOSIBCE004273_1     (610)  FVG----------------------------
O_sativa_LOC_Os01g62920_1_1           (610)  FVG----------------------------
O_sativa_Os01g0848400_1               (610)  FVG----------------------------
O_sativa_TA50671_4530_1               (610)  FVG----------------------------
TMxxx5170                             (610)  FVG----------------------------
Consensus                            (1001)  FVG
```

FIGURE 14 (continued)

METHOD FOR INCREASING PLANT YIELD BY EXPRESSING A NUCLEIC ACID ENCODING AN ORNITHINE DECARBOXYLASE POLYPEPTIDE AND PLANTS EXPRESSING THE SAME

RELATED APPLICATIONS

This application is a national stage application (under 35 U.S.C. §371) of PCT/EP2009/054484, filed Apr. 16, 2009, which claims benefit of European application 08154654.1, filed Apr. 16, 2008, U.S. Provisional Application 61/045,695, filed Apr. 17,2008, U.S. Provisional Application 61/058,237, filed Jun. 3, 2008, European application 08157456.8, filed Jun. 3, 2008, European Application 08157765.2, filed Jun. 6, 2008, U.S. Provisional Application 61/059,298, filed Jun. 6, 2008, U.S. Provisional Application 61/084,402, filed Jul. 29, 2008, European Application 08161345.7, filed Jul. 29, 2008, European Application 09151551.0, filed Jan. 28. 2009 and U.S. Provisional Application 61/151,520, filed Feb. 11, 2009.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence Listing 32279 00026. The size of the text file is 625 KB, and the text file was created on May 10, 2013.

The present invention relates generally to the field of molecular biology and concerns a method for enhancing various yield-related traits by modulating expression in a plant of a nucleic acid encoding an Ornithine Decarboxylase (ODC) polypeptide. The present invention also concerns plants having modulated expression of a nucleic acid encoding an ODC polypeptide, which plants have enhanced yield-related traits relative to corresponding wild type plants or other control plants. The invention also provides constructs useful in the methods of the invention.

In another embodiment, the present invention relates generally to the field of molecular biology and concerns a method for increasing various plant yield-related traits, by increasing expression in a plant of a nucleic acid sequence encoding a benzothiadiazole-induced homeodomain 1 (BIHD1) polypeptide. The present invention also concerns plants having increased expression of a nucleic acid sequence encoding a BIHD1 polypeptide, which plants have increased yield-related traits relative to control plants. The invention also provides constructs useful in the methods of the invention.

In yet another embodiment, the present invention relates generally to the field of molecular biology and concerns a method for enhancing various yield-related traits by modulating expression in a plant of a nucleic acid encoding a MYB30. The present invention also concerns plants having modulated expression of a nucleic acid encoding a MYB30 polypeptide, which plants have enhanced yield-related traits relative to corresponding wild type plants or other control plants. The invention also provides constructs useful in the methods of the invention.

In yet another embodiment, the present invention relates generally to the field of molecular biology and concerns a method for improving various plant growth characteristics by modulating expression in a plant of a nucleic acid encoding a THOM (tomato homeobox) protein. The present invention also concerns plants having modulated expression of a nucleic acid encoding a THOM polypeptide, which plants have improved growth characteristics relative to corresponding wild type plants or other control plants. The invention also provides constructs useful in the methods of the invention.

In a further embodiment, the present invention relates generally to the field of molecular biology and concerns a method for increasing various plant yield-related traits, by increasing expression in a plant of a nucleic acid sequence encoding a benzothiadiazole-induced homeodomain 2 (BIHD2) polypeptide. The present invention also concerns plants having increased expression of a nucleic acid sequence encoding a BIHD2 polypeptide, which plants have increased yield-related traits relative to control plants. The invention also provides constructs useful in the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Plant biomass is yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage.

These allometric relationships are used to extrapolate from one of these measures of size to another (e.g. Tittonell et al 2005 Agric Ecosys & Environ 105: 213). Plant size at an early developmental stage will typically correlate with plant size later in development. A larger plant with a greater leaf area can typically absorb more light and carbon dioxide than a smaller plant and therefore will likely gain a greater weight during the same period (Fasoula & Tollenaar 2005 *Maydica* 50:39). This is in addition to the potential continuation of the micro-environmental or genetic advantage that the plant had to achieve the larger size initially. There is a strong genetic component to plant size and growth rate (e.g. ter Steege et al 2005 Plant Physiology 139:1078), and so for a range of diverse genotypes plant size under one environmental condition is likely to correlate with size under another (Hittalmani et al 2003 Theoretical Applied Genetics 107:679). In this way a standard environment is used as a proxy for the diverse and dynamic environments encountered at different locations and times by crops in the field.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (*Zea mays* L.) hybrids based on Corn Belt germplasm in the European Atlantic.

Harvest index, the ratio of seed yield to aboveground dry weight, is relatively stable under many environmental conditions and so a robust correlation between plant size and grain yield can often be obtained (e.g. Rebetzke et al 2002 Crop Science 42:739). These processes are intrinsically linked because the majority of grain biomass is dependent on current or stored photosynthetic productivity by the leaves and stem of the plant (Gardener et al 1985 Physiology of Crop Plants. Iowa State University Press, pp 68-73). Therefore, selecting for plant size, even at early stages of development, has been used as an indicator for future potential yield (e.g. Tittonell et al 2005 Agric Ecosys & Environ 105: 213). When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

Another trait of importance is that of improved abiotic stress tolerance. Abiotic stress is a primary cause of crop loss worldwide, reducing average yields for most major crop plants by more than 50% (Wang et al., Planta (2003), 218: 1-14). Abiotic stresses may be caused by drought, salinity, extremes of temperature, chemical toxicity, excess or deficiency of nutrients (macroelements and/or microelements), radiation and oxidative stress. The ability to increase and/or improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increase yield-related traits and/or yield (seed yield and/or biomass) in plants may be through modification of the inherent growth mechanisms of a plant, such as the cell cycle or various signalling pathways involved in plant growth or in defense mechanisms.

It has now been found that various yield-related traits may be improved in plants by modulating expression in a plant of a nucleic acid encoding an Ornithine Decarboxylase (ODC) polypeptide in a plant.

In another embodiment it has now been found that various yield-related traits may be increased in plants relative to control plants, by increasing expression in a plant of a nucleic acid sequence encoding a benzothiadiazole-induced homeodomain 1 (BIHD1) polypeptide. The increased yield-related traits comprise one or more of: increased early vigour, increased total seed yield per plant, increased number of filled seeds, increased total number of seeds, and increased harvest index.

In yet another embodiment it has now been found that various enhanced yield-related traits may be enhanced in plants by modulating expression in a plant of a nucleic acid encoding a MYB30 in a plant.

In yet another embodiment it has now been found that various growth characteristics may be improved in plants by modulating expression in a plant of a nucleic acid encoding a THOM (tomato homeobox) protein in a plant.

In a further embodiment it has now been found that various yield-related traits may be increased in plants relative to control plants, by increasing expression in a plant of a nucleic acid sequence encoding a benzothiadiazole-induced homeodomain 2 (BIHD2) polypeptide. The increased yield-related traits comprise one or more of: increased early vigour, increased total seed yield per plant, increased number of filled seeds, increased total number of seeds, and increased harvest index.

BACKGROUND

Ornithin Decarboxylase (ODC)

Polyamines are basic aliphatic hydrocarbon compounds with two or more amino groups. Polyamines are ubiquitous natural substances occurring in organism with more than 20 types described. Examples of polyamines are spermine, spermidine and putrescine. Biological roles attributed to polyamines in plants include cell protection during abiotic stress and promotion of nucleic acid or protein biosynthesis. Enzymes catalyzing essential steps in polyamine biosynthesis include Spermine Synthase, Spermidine Synthase (SPDS) and several basic amino acid decarboxylases of the beta/alpha barrel fold type such as Ornithine Decarboxylases (ODC), Arginine Decarboxylase (ADC), S-adenosylmethionine Decarboxylase (SAMDC), Diaminopimelate Decarboxylase (DAPCD) and Carboxynorspermidine Decarboxylase (CANSDC). Genes encoding such enzymes have been isolated from prokaryotic and eukaryotic organism including plants. Beta/alpha-barrel fold decarboxylases segregate with respect to their phylogeny into four distinct groups containing ADCs, DAPDCs, ODCs, and CANSDCs (Lee et al. 2007. The Journal of Biological Chemistry Vol. 282, 27115-27125). These enzymes form homodimers. Two identical active sites are formed at the dimer interface between the N-terminal domain from one subunit and the C-terminal domain from the other.

Ornithine Decarboxylase or L-ornithine carboxy-lyase catalyses the decarboxilation of L-Ornithine to produce putrescine and CO2. ODCs are found in prokaryotes and eukaryotic organisms. The nomenclature assigned to ODC by the International Union Of Biochemistry And Molecular Biology is EC 4.1.1.17.

There has been considerable research in understanding the expression of plant polyamine metabolism-relate genes in response to stresses, and the use of such genes to alter the polyamine concentration in a cell. For example expression of a mouse ODC in carrot or a human ODC in transgenic rice plants altered the polyamine pools in the transgenic plant (Bastola and Minocha 1995. Plant Physiol. 1995. 109(1): 63-71. Lepri et al; 2001 Mol Genet Genomics. 2001 October; 266(2):303-12.). Immunomodulation of ODC in tobacco plants reportedly resulted in altered polyamine levels and developmental abnormalities and drawf phenotypes in the transgenic plants (Nolke et al; 2005. plant Biotechnology J. 3(2): 237-47. Expression of a cDNA encoding a mouse ODC in tobacco increased putrescine levels (Descenzo and Minocha 1993) Plant Mol Biol. 22, 113-127. In this study most transformant plants had normal appearance although those accumulating high levels of putrescine displayed stunted growth, wrinkled leaves and flowers with reduced stamen.

Surprisingly, it has now been found that modulating expression of a nucleic acid encoding an Ornithine Decarboxylase polypeptide gives plants having enhanced yield-related traits relative to control plants.

According to one embodiment, there is provided a method for enhancing yield related traits of a plant relative to control plants, comprising modulating expression of a nucleic acid encoding an Ornithine Decarboxylase polypeptide in a plant. The enhanced yield related traits comprised increased early vigour, increased seed yield and increased biomass.

Benzothiadiazole-induced Homeodomain Protein 1 (BIHD1)

DNA-binding proteins are proteins that comprise any of many DNA-binding domains and thus have a specific or general affinity to DNA. DNA-binding proteins include for example transcription factors that modulate the process of transcription, nucleases that cleave DNA molecules, and histones that are involved in DNA packaging in the cell nucleus.

Transcription factors are usually defined as proteins that show sequence-specific DNA binding affinity and that are capable of activating and/or repressing transcription. The *Arabidopsis thaliana* genome codes for at least 1533 transcriptional regulators, accounting for ~5.9% of its estimated total number of genes (Riechmann et al. (2000) Science 290: 2105-2109). The Database of Rice Transcription Factors (DRTF) is a collection of known and predicted transcription factors of *Oryza sativa* L. ssp. *indica* and *Oryza sativa* L. ssp. *japonica*, and currently contains 2,025 putative transcription factors (TF) gene models in *indica* and 2,384 in *japonica*, distributed in 63 families (Gao et al. (2006) Bioinformatics 2006, 22(10):1286-7).

One of these families is the superfamily of homeodomain (HD) transcription factors involved in many aspects of developmental processes. HD transcription factors are characterized by the presence of a homeodomain (HD), which is a 60-amino acid DNA-binding domain (BD). *Arabidopsis thaliana* and rice contain approximately 100 HD transcription factors, which can be further classified into subfamilies based on amino acid sequence identity (Richardt et al. (2007) Plant Phys 143(4): 1452-1466). Some of these subfamilies are characterized by the presence of additional conserved domains that facilitate DNA binding and/or protein-protein interactions.

One of these subfamilies is the BEL1 (BELL-1) subfamily (Reiser et al. (1995), Cell 83: 735-742), named after an *Arabidopsis* mutant bell1 with defective integument formation. BEL1 transcription factors are characterized, in addition to the homeodomain, by a conserved domain called the POX domain, found exclusively in plant proteins. Two motifs further characterize BEL1 polypeptides: the SKY box, and the VSLTGL box, named after the conserved amino acid residues they comprise.

A gene encoding a BEL1 homeodomain polypeptide was isolated from *Oryza sativa*, and its expression shown to be increased upon treatment with benzothiadiazole (BTH), a molecule capable of inducing disease resistance, but also upon inoculation with *Magnaporthe grisea* pathogen (Luo et al. (2005) Plant Biol 7: 459-468). It was named *Oryza sativa* benzothiadiazole induced homeodomain 1 (OsBIHD1). The gene was overexpressed in tobacco using the CaMV 35S promoter (Luo et al. (2005) J Ex Bot 56(420): 2673-2682). Transgenic tobacco plants showed enhanced disease tolerance, and in some instance, germinated apical buds, abnormal roots, reduced fertility or infertility.

Surprisingly, it has now been found that increasing expression of a nucleic acid sequence encoding a benzothiadiazole-induced homeodomain protein 1 (BIHD1) gives plants having increased yield-related traits relative to control plants.

According to one embodiment, there is provided a method for increasing yield-related traits in plants relative to control plants, comprising increasing expression of a nucleic acid sequence encoding a BIHD1 polypeptide as defined herein, in a plant. The increased yield-related traits comprise one or more of: increased early vigour, increased total seed yield per plant, increased number of filled seeds, increased total number of seeds, and increased harvest index.

MYB30 Protein

MYB domain proteins are transcription factors with a highly conserved DNA-binding domain. The MYB domain was originally described in the oncogene (v-myb) of avian myeloblastosis virus (Klempnauer et al. (1982) Cell 33, 453-63). Many vertebrates contain three genes related to v-Myb, c-Myb, A-Myb and B-Myb and other similar genes have been identified in insects, plants, fungi and slime moulds. The encoded proteins are crucial to the control of proliferation and differentiation in a number of cell types. MYB proteins contain one to four imperfect direct repeats of a conserved sequence of 50-53 amino acids which encodes a helix-turn-helix structure involved in DNA binding (Rosinski and Atchley (1998) J Mol Evol 46, 74-83). Three regularly spaced tryptophan residues, which form a tryptophan cluster in the three-dimensional helix-turn-helix structure, are characteristic of a MYB repeat. The three repeats in c-Myb are referred to as R1, R2 and R3; and repeats from other MYB proteins are categorised according to their similarity to R1, R2 or R3. MYB proteins can be classified into three subfamilies depending on the number of adjacent repeats in the MYB domain (one "MYB1R", two "R2R3-type MYB", three "MYB3R"). Since there is little sequence conservation outside of the MYB domain, MYB proteins have been clustered into subgroups based on conserved motifs identified outside of the MYB coding region (Stracke et al. 2001. Curr Opin Plant Biol. October; 4(5):447-56; Jiang et al. (2004) Genome Biology 5, R46). In contrast to animals, plants contain a MYB-protein subfamily that is characterised by the R2R3-type MYB domain.

Plant Myb genes are have been suggested to play important roles in regulation of secondary metabolism, cellular morphogenesis, pathogen resistance, and responses to growth regulators and stress. Additionally WO 2007099096 discloses a rice MYB4 protein useful for increasing seed yield in plants.

The MYB30 class of transcription factors constitutes a subgroup of Myb proteins sharing a common evolutionary origin and corresponding to the Group G09 reported by Jiang et al. 2004. Genes encoding some members of the MYB30 class of proteins have been implicated in physiological responses in guard cells and activation of the hypersensitive cell death response in *Arabidopsis thaliana* (Cominelli et al. Curr Biol. 2005 15(13):1196-200; Rivas and Roby FEBS Lett. 2006. 580(14):3498-504). The accumulation of extracellular VLCFA (very-long-chain fatty acids)-derived metabolites (leaf epidermal wax components) was affected in MYB30 knockout mutants and overexpressing lines in *Arabidopsis thaliana* (Vailleau et al. 2008. Plant Cell. March 7 [Epub ahead of print].).

Surprisingly, it has now been found that modulating expression of a nucleic acid encoding a MYB30 polypeptide gives plants having enhanced yield-related traits, in particular increased vegetative biomass and increased emergence vigour relative to control plants.

According to one embodiment, there is provided a method for enhanced yield-related traits of a plant relative to control plants, comprising modulating expression of a nucleic acid encoding a MYB30 polypeptide in a plant. The improved yield-related traits comprise increased biomass and increased emergence vigour.

Tomato Homeodomain (THOM)

Homeodomain leucine zipper (HDZip) proteins constitute a family of transcription factors characterized by the presence of a DNA-binding domain (HD) and an adjacent leucine zipper (Zip) motif. The homeodomain usually consists of 60 conserved amino acid residues that form a helix1-loop-helix2-turn-helix3 that binds DNA. This DNA binding site is usually pseudopalindromic. The leucine zipper, adjacent to the C-terminal end of the homeodomain, consists of several heptad repeats (at least four) in which usually a leucine (occasionally a valine or an isoleucine) appears every seventh amino acid. The leucine zipper is important for protein dimerisation. This dimerisation is a prerequisite for DNA binding (Sessa et al. (1993) EMBO J 12(9): 3507-3517), and may proceed between two identical HDZip proteins (homodimer) or between two different HDZip proteins (heterodimer).

Homeodomain genes are present in all eucaryotes, and constitute a gene family of at least 89 members in *Arabidopsis thaliana*. The leucine zipper is also found by itself in eukaryotes other than plants. However, the presence of both a homeodomain and a leucine zipper is plant-specific (found in at least 47 out of the 89 proteins in *Arabidopsis*), and has been encountered in moss in addition to vascular plants (Sakakibara et al. (2001) Mol Biol Evol 18(4): 491-502, which is incorporated herein by reference). The leucine zipper is then located at the C-terminal end of the homeodomain, these two features overlapping by three amino acids.

The *Arabidopsis* HDZip genes have been classified into four different classes, HDZip I to IV, based on sequence similarity criteria (Sessa et al. In: Plant Molecular Biology (NATO ASI Series, vol H81), pp 412-426, 1994). HD-Zip I and II genes are likely involved in signal transduction networks of light, dehydration-induced ABA, or auxin. These signal transduction networks are related to the general growth regulation of plants. The overexpression of sense or antisense HD-Zip I or II mRNA usually alters growth rate and development. Most members of the HD-Zip III subfamily play roles in cell differentiation in the stele. HD-Zip IV genes are related to the differentiation of the outermost cell layer (Sakakibara et al., 2001).

Several members of the closely related HD-Zip I and II families have been related to auxin signaling and transport. HDZip I and II genes also have been implicated in light signalling responses, including shade-avoidance, de-etiolation of dark-grown seedlings and blue light signaling. Furthermore, there is accumulating evidence that many HD-Zip I and II genes are related to regulation of developmental adaptation to environmental stress conditions such as drought, for an overview, see Agalou et al., Plant Molecular Biology 66, 87-103, 2008. By random binding site selection in vitro the favoured recognition site for the *Arabidopsis* HD-Zip family I protein Athb-1 was shown to be composed of two 5-bp half-sites that overlap at a central position, CAAT (A/T)ATTG (Sessa et al. EMBO J. 12, 3507-3517, 1993). The HD-Zip II protein Athb-2 interacts with a similar 9-bp sequence but shows a preference for a G/C base pair at the central position. This preference was shown to be determined by the presence of Glu and Thr residues at positions 46 and 56 of the 60-amino acid homeodomain, where HD-Zip I proteins characteristically contain, respectively, an Ala and a Trp residue (Sessa et al. J. Mol. Biol. 274, 303-309, 1997). THOM1 from tomato (Meisner and Theres, Planta 195, 541-547, 1995) is highly expressed in the vegetative shoot apical meristem, the floral meristem and axillary meristems. Young derivatives of these meristems show similar levels of THOM1 transcripts which decrease with increasing age of the respective tissue. HB-4, a member of the HD-Zip class II proteins and homologous to THOM, was shown to be induced in *Arabidopsis* by far-red-rich light treatment; whereas in sunflower, HB-4 is regulated by water availability and abscisic acid. It was postulated that sunflower HB-4 is involved in increasing desiccation tolerance (Manavella et al., Plant J. 48, 125-137, 2006).

Surprisingly, it has now been found that modulating expression of a nucleic acid encoding a THOM polypeptide gives plants having enhanced yield-related traits, in particular increased seed yield relative to control plants.

According one embodiment, there is provided a method for improving yield related traits of a plant relative to control plants, comprising modulating expression of a nucleic acid encoding a THOM polypeptide in a plant.

Benzothiadiazole-induced Homeodomain Protein 2 (BIHD2)

DNA-binding proteins are proteins that comprise any of many DNA-binding domains and thus have a specific or general affinity to DNA. DNA-binding proteins include for example transcription factors that modulate the process of transcription, nucleases that cleave DNA molecules, and histones that are involved in DNA packaging in the cell nucleus.

Transcription factors are usually defined as proteins that show sequence-specific DNA binding affinity and that are capable of activating and/or repressing transcription. The *Arabidopsis thaliana* genome codes for at least 1533 transcriptional regulators, accounting for ~5.9% of its estimated total number of genes (Riechmann et al. (2000) Science 290:

2105-2109). The Database of Rice Transcription Factors (DRTF) is a collection of known and predicted transcription factors of *Oryza sativa* L. ssp. *indica* and *Oryza sativa* L. ssp. *japonica*, and currently contains 2,025 putative transcription factors (TF) gene models in *indica* and 2,384 in *japonica*, distributed in 63 families (Gao et al. (2006) Bioinformatics 2006, 22(10):1286-7).

One of these families is the superfamily of homeodomain (HD) transcription factors involved in many aspects of developmental processes. HD transcription factors are characterized by the presence of a homeodomain (HD), which is a 60-amino acid DNA-binding domain (BD). *Arabidopsis thaliana* and rice contain approximately 100 HD transcription factors, which can be further classified into subfamilies based on amino acid sequence identity (Richardt et al. (2007) Plant Phys 143(4): 1452-1466). Some of these subfamilies are characterized by the presence of additional conserved domains that facilitate DNA binding and/or protein-protein interactions.

One of these subfamilies is the BEL1 (BELL-1) subfamily (Reiser et al. (1995), Cell 83: 735-742), named after an *Arabidopsis* mutant bell1 with defective integument formation. BEL1 transcription factors are characterized, in addition to the homeodomain, by a conserved domain called the POX domain, found exclusively in plant proteins. Two motifs further characterize BEL1 polypeptides: the SKY box, and the VSLTGL box, named after the conserved amino acid residues they comprise.

A gene encoding a BEL1 homeodomain polypeptide was isolated from *Oryza sativa*, and its expression shown to be increased upon treatment with benzothiadiazole (BTH), a molecule capable of inducing disease resistance, but also upon inoculation with *Magnaporthe grisea* pathogen (Luo et al. (2005) Plant Biol 7: 459-468). It was named *Oryza sativa* benzothiadiazole induced homeodomain 1 (OsBIHD1). The gene was overexpressed in tobacco using the CaMV 35S promoter (Luo et al. (2005) J Ex Bot 56(420): 2673-2682). Transgenic tobacco plants showed enhanced disease tolerance, and in some instance, germinated apical buds, abnormal roots, reduced fertility or infertility.

Surprisingly, it has now been found that increasing expression of a nucleic acid sequence encoding a benzothiadiazole-induced homeodomain protein 2 (BIHD2) gives plants having increased yield-related traits relative to control plants.

According to one embodiment, there is provided a method for increasing yield-related traits in plants relative to control plants, comprising increasing expression of a nucleic acid sequence encoding a BIHD2 polypeptide as defined herein, in a plant. The increased yield-related traits comprise one or more of: increased early vigour, increased total seed yield per plant, increased number of filled seeds, increased total number of seeds, and increased harvest index.

Definitions

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions | Residue | Conservative Substitutions |
|---|---|---|---|
| Ala | Ser | Leu | Ile; Val |
| Arg | Lys | Lys | Arg; Gln |
| Asn | Gln; His | Met | Leu; Ile |
| Asp | Glu | Phe | Met; Leu; Tyr |
| Gln | Asn | Ser | Thr; Gly |
| Cys | Ser | Thr | Ser; Val |
| Glu | Asp | Trp | Tyr |
| Gly | Pro | Tyr | Trp; Phe |

TABLE 1-continued

| Examples of conserved amino acid substitutions | | | |
|---|---|---|---|
| Residue | Conservative Substitutions | Residue | Conservative Substitutions |
| His | Asn; Gln | Val | Ile; Leu |
| Ile | Leu, Val | | |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

Motif/Consensus Sequence/Signature

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m=81.5° C.+16.6\times\log_{10}[Na^+]^a+0.41\times\%[G/C^b]-500\times[L^c]^{-1}-0.61\times\% \text{ formamide}$$

2) DNA-RNA or RNA-RNA hybrids:

$$T_m=79.8+18.5(\log_{10}[Na^+]^a)+0.58(\% G/C^b)+11.8(\% G/C^b)^2-820/L^c$$

3) oligo-DNA or oligo-RNAs hybrids:

For <20 nucleotides: $T_m=2(I_n)$

For 20-35 nucleotides: $T_m=22+1.46(I_n)$

[a] or for other monovalent cation, but only accurate in the 0.01-0.4 M range.

[b] only accurate for % GC in the 30% to 75% range.

[c] L=length of duplex in base pairs.

[d] oligo, oligonucleotide; $I_n$, =effective length of primer=2×(no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 μg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3rd Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
|---|---|
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |

TABLE 2a-continued

Examples of constitutive promoters

| Gene Source | Reference |
|---|---|
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-specific/Tissue-specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
|---|---|
| RCc3 | Plant Mol Biol. 1995 Jan; 27(2): 237-48 |
| *Arabidopsis* PHT1 | Kovama et al., 2005; Mudge et al. (2002, Plant J. 31: 341) |
| Medicago phosphate transporter | Xiao et al., 2006 |
| *Arabidopsis* Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |

TABLE 2b-continued

| Examples of root-specific promoters | |
|---|---|
| Gene Source | Reference |
| β-tubulin | Oppenheimer, et al., Gene 63: 87, 1988. |
| tobacco root-specific genes | Conkling, et al., Plant Physiol. 93: 1203, 1990. |
| *B. napus* G1-3b gene | U.S. Pat. No. 5,401,836 |
| SbPRP1 | Suzuki et al., Plant Mol. Biol. 21: 109-119, 1993. |
| LRX1 | Baumberger et al. 2001, Genes & Dev. 15: 1128 |
| BTG-26 *Brassica napus* | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 153: 386-395, 1991. |
| KDC1 (*Daucus carota*) | Downey et al. (2000, J. Biol. Chem. 275: 39420) |
| TobRB7 gene | W Song (1997) PhD Thesis, North Carolina State University, Raleigh, NC USA |
| OsRAB4a (rice) | Wang et al. 2002, Plant Sci. 163: 273 |
| ALF5 (*Arabidopsis*) | Diener et al. (2001, Plant Cell 13: 1625) |
| NRT2; 1Np (*N. plumbaginifolia*) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters (endosperm/aleurone/embryo specific) are shown in Table 2c to Table 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

| Examples of seed-specific promoters | |
|---|---|
| Gene source | Reference |
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley Itr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| *sorghum* α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2d

| examples of endosperm-specific promoters | |
|---|---|
| Gene source | Reference |
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al, (1998) Plant J 116(1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39(8) 885-889 |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| *sorghum* kafirin | DeRose et al. (1996) Plant Mol Biol 32: 1029-35 |

TABLE 2e

| Examples of embryo specific promoters: | |
|---|---|
| Gene source | Reference |
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2f

| Examples of aleurone-specific promoters: | |
|---|---|
| Gene source | Reference |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2g below.

TABLE 2g

| Examples of green tissue-specific promoters | | |
|---|---|---|
| Gene | Expression | Reference |
| Maize Orthophosphate dikinase | Leaf specific | Fukavama et al., 2001 |
| Maize Phosphoenolpyruvate carboxylase | Leaf specific | Kausch et al., 2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2h below.

TABLE 2h

| Examples of meristem-specific promoters | | |
|---|---|---|
| Gene source | Expression pattern | Reference |
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other *eukaryotic* gene.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants. Methods for decreasing expression are known in the art and the skilled person would readily be able to adapt the known methods for silencing so as to achieve reduction of expression of an endogenous gene in a whole plant or in parts thereof through the use of an appropriate promoter, for example.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

Examples of various methods for the reduction or substantial elimination of expression in a plant of an endogenous gene, or for lowering levels and/or activity of a protein, are known to the skilled in the art. A skilled person would readily be able to adapt the known methods for silencing, so as to achieve reduction of expression of an endogenous gene in a whole plant or in parts thereof through the use of an appropriate promoter, for example.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. MiRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die). The marker genes may be removed or excised from the transgenic cell once they are no longer needed. Techniques for marker gene removal are known in the art, useful techniques are described above in the definitions section.

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or (b) genetic control sequence(s) which is operably linked with the nucleic acid sequence according to the invention, for example a promoter, or (c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen. Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an *agrobacterial* solution and then culturing them in suitable media. The transformation of plants by means of *Agrobacterium tumefaciens* is described, for example, by Höofgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic [Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an *agrobacterial* suspension [Bechthold, N (1993). C R Acad Sci Paris Life Sci, 316: 1194-1199], while in the case of the "floral dip" method the developing floral tissue is incubated briefly with a surfactant-treated *agrobacterial* suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

TILLING

The term “TILLING” is an abbreviation of “Targeted Induced Local Lesions In Genomes” and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offring a et al. (1990) EMBO J 9(10): 3077-84) but also for crop plants, for example rice (Terada et al. (2002) Nat Biotech 20(10): 1030-4; lida and Terada (2004) Curr Opin Biotech 15(2): 132-8), and approaches exist that are generally applicable regardless of the target organism (Miller et al, Nature Biotechnol. 25, 778-785, 2007).

Yield

The term “yield” in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term “yield” of a plant may relate to vegetative biomass (root and/or shoot biomass), to reproductive organs, and/or to propagules (such as seeds) of that plant.

Early Vigour

“Early vigour” refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increase/Improve/Enhance

The terms “increase”, “improve” or “enhance” are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per square meter; b) increased number of flowers per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; and f) increased thousand kernel weight (TKW), and g) increased number of primary panicles, which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased seed yield may also result in modified architecture, or may occur because of modified architecture.

Greenness Index

The “greenness index” as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Plant

The term “plant” as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term “plant” also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana, Agropyron* spp., *Agrostis stolonifera, Allium* spp., *Amaranthus* spp., *Ammophila arenaria, Ananas comosus, Annona* spp., *Apium graveolens, Arachis spp, Artocarpus* spp., *Asparagus officinalis, Avena* spp. (e.g. *Avena sativa, Avena fatua, Avena byzantina, Avena fatua* var. *sativa, Avena* hybrida), *Averrhoa carambola, Bambusa* sp., *Benincasa hispida, Bertholletia excelsea, Beta vulgaris, Brassica* spp. (e.g. *Brassica napus, Brassica rapa* ssp. [canola, oilseed rape, turnip rape]), *Cadaba farinosa, Camellia sinensis, Canna indica, Cannabis sativa, Capsicum* spp., *Carex elata, Carica papaya, Carissa macrocarpa, Carya* spp., *Carthamus tinctorius, Castanea* spp., *Ceiba pentandra, Cichorium endivia, Cinnamomum* spp., *Citrullus lanatus, Citrus* spp., *Cocos* spp., *Coffea* spp., *Colocasia esculenta, Cola* spp., *Corchorus* sp., *Coriandrum sativum, Corylus* spp., *Crataegus* spp., *Crocus sativus, Cucurbita* spp., *Cucumis* spp., *Cynara* spp., *Daucus carota, Desmodium* spp., *Dimocarpus longan, Dioscorea* spp., *Diospyros* spp., *Echinochloa* spp., *Elaeis* (e.g. *Elaeis guineensis, Elaeis oleifera*), *Eleusine coracana, Eragrostis tef, Erianthus* sp., *Eriobotrya japonica, Eucalyptus* sp., *Eugenia uniflora, Fagopyrum* spp., *Fagus* spp., *Festuca arundinacea, Ficus carica, Fortunella* spp., *Fragaria* spp., *Ginkgo biloba, Glycine* spp. (e.g. *Glycine max, Soja hispida* or *Soja max*), *Gossypium hirsutum, Helianthus* spp. (e.g. *Helianthus annuus*), *Hemerocallis fulva, Hibiscus* spp., *Hordeum* spp. (e.g. *Hordeum vulgare*), *Ipomoea batatas, Juglans* spp., *Lactuca sativa, Lathyrus* spp., *Lens culinaris, Linum usitatissimum, Litchi chinensis, Lotus* spp., *Luffa acutangula, Lupinus* spp., *Luzula sylvatica, Lycopersicon* spp. (e.g. *Lycopersicon esculentum, Lycopersicon lycopersicum, Lycopersicon pyriforme*), *Macrotyloma* spp., *Malus* spp., *Malpighia emarginata, Mammea americana, Mangifera indica, Manihot* spp., *Manilkara zapota, Medicago sativa, Melilotus* spp., *Mentha* spp., *Miscanthus sinensis, Momordica* spp., *Morus nigra, Musa* spp., *Nicotiana* spp., *Olea* spp., *Opuntia* spp., *Ornithopus* spp., *Oryza* spp. (e.g. *Oryza sativa, Oryza latifolia*), *Panicum miliaceum, Panicum virgatum, Passiflora edulis, Pastinaca sativa, Pennisetum* sp., *Persea* spp., *Petroselinum crispum, Phalaris arundinacea, Phaseolus* spp., *Phleum pratense, Phoenix* spp., *Phragmites australis, Physalis* spp., *Pinus* spp., *Pistacia vera, Pisum* spp., *Poa* spp., *Populus* spp., *Prosopis* spp., *Prunus* spp., *Psidium* spp., *Punica granatum, Pyrus communis, Quercus* spp., *Raphanus sativus, Rheum rhabarbarum, Ribes* spp., *Ricinus communis, Rubus* spp., *Saccharum* spp., *Salix* sp., *Sambucus* spp., *Secale cereale, Sesamum* spp., *Sinapis* sp., *Solanum* spp. (e.g. *Solanum tuberosum, Solanum integrifolium* or *Solanum lycopersicum*), *Sorghum bicolor, Spinacia* spp., *Syzygium* spp., *Tagetes* spp., *Tamarindus indica, Theobroma cacao, Trifolium* spp., *Tripsacum dactyloides, Triticale* sp., *Triticosecale rimpaui, Triticum* spp. (e.g. *Triticum aestivum, Triticum durum, Triticum turgidum, Triticum hybernum, Triticum macha, Triticum sativum, Triticum monococcum* or *Triticum vulgare*), *Tropaeolum minus, Tropaeolum majus, Vaccinium* spp., *Vicia* spp., *Vigna* spp., *Viola odorata, Vitis* spp., *Zea mays, Zizania palustris, Ziziphus* spp., amongst others.

DETAILED DESCRIPTION OF THE INVENTION

Surprisingly, it has now been found that modulating expression in a plant of a nucleic acid sequence encoding an Ornithine Decarboxylase polypeptide gives plants having enhanced yield-related traits relative to control plants. According to an embodiment, the present invention provides a method for enhancing yield-related traits in plants relative to control plants, comprising modulating expression in a plant of a nucleic acid encoding an Ornithine Decarboxylase polypeptide.

Furthermore surprisingly, it has now been found that increasing expression in a plant of a nucleic acid sequence encoding a BIHD1 polypeptide as defined herein, gives plants having increased yield-related traits relative to control plants. According to another embodiment, the present invention provides a method for increasing yield-related traits in plants relative to control plants, comprising increasing expression in a plant of a nucleic acid sequence encoding a BIHD1 polypeptide.

Furthermore surprisingly, it has now been found that modulating expression in a plant of a nucleic acid encoding a MYB30 polypeptide gives plants having enhanced yield-related traits relative to control plants. According to a first embodiment, the present invention provides a method for enhancing yield-related traits in plants relative to control plants, comprising modulating expression in a plant of a nucleic acid encoding a MYB30 polypeptide.

Furthermore surprisingly, it has now been found that modulating expression in a plant of a nucleic acid encoding a THOM polypeptide gives plants having enhanced yield-related traits relative to control plants. According to a first embodiment, the present invention provides a method for enhancing yield-related traits in plants relative to control plants, comprising modulating expression in a plant of a nucleic acid encoding a THOM polypeptide.

Furthermore surprisingly, it has now been found that increasing expression in a plant of a nucleic acid sequence encoding a BIHD2 polypeptide as defined herein, gives plants having increased yield-related traits relative to control plants. According to a first embodiment, the present invention provides a method for increasing yield-related traits in plants relative to control plants, comprising increasing expression in a plant of a nucleic acid sequence encoding a BIHD2 polypeptide, and optionally selecting for plants having increased yield-related traits.

A preferred method for modulating (preferably, increasing) expression of a nucleic acid sequence encoding an ODC polypeptide, or a BIHD1 polypeptide, or a MYB30 polypeptide, or a THOM polypeptide, or a BIHD2 polypeptide is by introducing and expressing in a plant a nucleic acid sequence encoding an ODC polypeptide, or a BIHD1 polypeptide, or a MYB30 polypeptide, or a THOM polypeptide, or a BIHD2 polypeptide.

Concerning ODC polypeptides/genes, any reference hereinafter to a "protein useful in the methods of the invention" is taken to mean an Ornithine Decarboxylase polypeptide as defined herein. Any reference hereinafter to a "nucleic acid useful in the methods of the invention" is taken to mean a nucleic acid capable of encoding such an Ornithine Decarboxylase polypeptide. The nucleic acid to be introduced into a plant (and therefore useful in performing the methods of the invention) is any nucleic acid encoding the type of protein which will now be described, hereafter also named "Ornithine Decarboxylase nucleic acid" or "Ornithine Decarboxylase gene".

An ODC polypeptide as referred to ein is able to act on L-Ornithine as substrate in a decarboxylation reaction and therefore catalyzes the reaction to produce putrescine from L-ornithine. Thus an Ornithine Decarboxylase polypeptide catalyses the following reaction: L-ornithine=putrescine+CO2. Ornithine (2,5-diaminopentanoic acid) is an amino acid having the chemical composition C5H12N2O2. Putrescine (sometimes spelled putrescin or putrescene) is an organic chemical compound having the chemical composition C4H12N2 (1,4-diaminobutane or butanediamine). FIG. 1 shows the L-Ornithine decarboxilation reaction.

Ornithine Decarboxylase polypeptides share similarity in the primary sequence and in the secondary structure. They belong to the beta/alpha barrel decarboxylase class of proteins. In a phylogenetic analysis of beta/alpha barrel decarboxylase, ODCs constitute a distinct clade of proteins.

Ornithine Decarboxylase polypeptides useful in the methods of the invention cluster when used in the construction of a Phylogenetic tree of alpha/beta-barrel fold basic amino acid decarboxylase polypeptides within the clade constituted by known Ornithine Decarboxylase rather than with Arginine Decarboxylase, Diaminopimelate Decarboxylase, or Carboxynorspermidine Decarboxylase polypeptides. Preferably an OCD useful in the methods of the invention clusters within the clade constituted by ODCs polypeptides of eukaryotic origin, further preferably cluster within the clade constituted by ODC polypeptides of plant origin, even more preferably cluster the clade constituted by ODC polypeptides of dicotyledoneous origin, most preferably cluster within the same clade as SEQ ID NO: 2. Examples of such Phylogenetic tree of alpha/beta-barrel fold basic amino acid decarboxylase polypeptides is given in FIG. 1 of Lee et al. 2007 and FIG. 2 B of the present application.

Methods for the inference of phylogeny are well known in the art and include "distance methods" based on a matrix containing pair wise distance values between all sequences in an alignment, and "character-based methods" that carry out calculations on each of the individual residues of the sequences. Examples of "distance methods" are the UPGMA (Unweighted Pair Group with Arithmetic Mean) and Neighbor-joining (Saitou and Nei, 1987). The latter method is used in well known sofware programs useful in performing protein phylogenesis such as Neighbor of the Phylip package (Jo Felsentein, Univ. Washington), or ClustalW (D. Higgins, EMBL). Examples of "character-based methods" are the Protein Maximum likelihood and Protein maximal parsimony. The skill person in the art is knowledgeable in the various available methods and is able to select advantageously the method of phylogeny analysis. A preferred method for the inference of phylogeny of ODCs polypeptides is the Neighbor-joining method.

A preferrred Ornitine Decarboxylase polypeptide useful in the methods of the invention comprise in increasing order of preference one or more of the following sequence motifs:

(i) Motif 1: (SEQ ID NO: 51)
[N/G]AR[C/V]P[L/M][G/S][P/L]K[Y/F]GALPEE[V/A]EPLL[R/Q][A/T]A[Q/K][A/E][A/L][G/R]LTV[S/V]GVSFH[V/I]GSG;

(ii) Motif 2: (SEQ ID NO: 52)
[K/D][D/Q][P/A]FYV[L/V]DL[G/A][E/V]VV[S/R]LMDQW[R/K/N][A/S];

(iii) Motof 3: (SEQ ID NO: 53)
RI[V/I][[F/Y]ANPCK[P/R]ES[D/H]I[I/K/R][Y/F]AA[K/S]VGVNLTT[Y/F]DSEDE[V/L][Y/E]K[I/V][R/A/K]KHHP;

(iv) Motif 4: (SEQ ID NO: 54)
EY[W/Y]I[N/D]DG[L/V/I]YGS[F/M/L]NC[I/V]L[Y/F]DHAT;

(v) Motif 5: (SEQ ID NO: 55)
EYVLSLG[V/I]SPD;

(vi) Motif 6: (SEQ ID NO: 56)
AI[A/E]AA[K/R]EVF[E/D][T/A]A[A/S][K/Q/R][L/F]G[M/L][P/S][K/R/P]M[T/R]VL[D/N][I/V]GGGFT[S/A]G[H/P]QF[T/E][T/E]AA[A/V][A/K/V][V/I][K/N][S/A];

-continued (vii) Motif 7: (SEQ ID NO: 57)
[G/I]G[G/A]AP[P/T/V]AAAA[A/E][EN][N/D/G][G/H]TRKV[V/I]PLS[R/K]DALQDFM[V/L]SIITQKLQD[E/D];

(viii) Motif 8: (SEQ ID NO: 58)
QT[V/I]IVSGLNPAAILQ;

(ix) a motif having in increasing order of preference at least 50%, 55%, 60%, 65%, 70%, 75%, 80%, 85%, 90%, 95%, 96%, 97%, 98%, 99% or more sequence identity to any one of the motifs (i) to (viii).

ODC polypeptides comprise various well known conserved protein domains. Proteins sharing common conserved domains are regarded as performing same or related functions.

Methods to identify conserved domains are well known in the art and include the searching of specialized datatabases such as Interpro (Mulder et al., (2003) Nucl. Acids. Res. 31, 315-318), Prosite (Bucher and Bairoch (1994), and Pfam (Bateman et al., Nucleic Acids Research 30(1): 276-280 (2002)). Example 4 details the conserved domains found SEQ ID NO: 2 by screening Interpro database.

A further preferred ODC polypeptide useful in the methods of the invention comprises one or more of the following conserved sequences:

(i) A PFAM domain with accession number PF00278 also referred to as Pyridoxal-dependent decarboxylase, C-terminal sheet domain or Orn_DAP_Arg_deC;

(ii) A PFAM domain with accession number PF02784 also referred to as Pyridoxal-dependent decarboxylase, pyridoxal binding domain or Orn_Arg_deC_N;

(iii) A PROSITE pattern with accession number PS00878 also referred to as ODR_DC__2__1 or Orn/DAP/Arg decarboxylases family 2 pyridoxal-P attachment site having a consensus pattern as represented by [F/Y]-[P/A]-x-K-[S/A/C/V]-[N/H/C/L/F/W]-x(4)-[L/I/V/M/F]-[L/I/V/M/T/A]-x(2)-[L/I/V/M/A]-x(3)-[G/T/E] (SEQ ID NO: 64);

(iv) A PROSITE pattern accession number PS00879 also referred to as ODR_DC__2__2 or Orn/DAP/Arg decarboxylases family 2 signature 2, having a consensus pattern as represented by [G/S/A]-x(2,6)-[L/I/V/M/S/C/P]-x-N-[L/I/V/M/F]-[D/N/S]-[L/I/V/M/C/A]-G(3)-[L/I/V/M/F/Y]-[G/S/T/P/C/E/Q] (SEQ ID NO: 65);

(v) a motif having in increasing order of preference at least 50%, 55%, 60%, 65%, 70%, 75%, 80%, 85%, 90%, 95%, 96%, 97%, 98%, 99% or more sequence identity to any one of the motifs (i) to (iv).

An even further preferred ODC polypeptide useful in the methods of the invention comprises a domain having in increasing order of preference at least 50%, 55%, 60%, 65%, 70%, 75%, 80%, 85%, 90%, 95%, 96%, 97%, 98%, 99% or more sequence identity to the amino acid sequence of any of the domains as set forth in Table C1 of Example 4.

Examples of ODC polypeptides useful in the methods of the invention are given in Table A1 of Example 1 herein. Global sequence similarity and identity between selected polypeptides of Table A1 is given in Table B1 of Example 3.

Further preferably ODC polypeptides useful in the methods of the invention comprise a sequence having in increasing order of preference at least 30%, 35%, 40%, 45%, 50%, 55%, 60%, 65%, 70%, 75%, 80%, 85%, 90%, 95%, 96%, 97%, 98%, 99% or more sequence identity to the amino acid sequence of any of the polypeptides of Table A1. Further preferably is any of the polypeptides of Table A1. Most preferably is SEQ ID NO: 2.

Alternatively, the homologue of an ODC protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 2, provided that the homologous protein comprises the conserved motifs as outlined above. The overall sequence identity is determined using a global alignment algorithm, such as the Needleman Wunsch algorithm in the program GAP (GCG Wisconsin Package, Accelrys), preferably with default parameters. Compared to overall sequence identity, the sequence identity will generally be higher when only conserved domains or motifs are considered.

Preferably, the polypeptide sequence which when used in the construction of a phylogenetic tree, such as the one depicted in FIG. 2 B, clusters preferably with the group of ODC polypeptides, most preferably with the group comprising the amino acid sequence represented by SEQ ID NO: 2 rather than with any other group.

Concerning BIHD1 polypeptides/genes, any reference hereinafter to a "protein useful in the methods of the invention" is taken to mean a BIHD1 polypeptide as defined herein. Any reference hereinafter to a "nucleic acid sequence useful in the methods of the invention" is taken to mean a nucleic acid sequence capable of encoding such a BIHD1 polypeptide. The nucleic acid sequence to be introduced into a plant (and therefore useful in performing the methods of the invention) is any nucleic acid sequence encoding the type of polypeptide, which will now be described, hereafter also named "BIHD1 nucleic acid sequence" or "BIHD1 gene".

A "BIHD1 polypeptide" as defined herein refers to any polypeptide having in increasing order of preference at least 50%, 55%, 60%, 65%, 70%, 75%, 80%, 85%, 90%, 95%, 98%, 99% or more amino acid sequence identity to a BIHD1 polypeptide as represented by SEQ ID NO: 67.

Alternatively or additionally, a "BIHD1 polypeptide" as defined herein refers to any polypeptide comprising: (i) a homeobox domain with an InterPro accession IPRO001356; (ii) a POX domain with an InterPro accession IPRO06563; and (ii) at least one predicted coiled coil domain.

Alternatively or additionally, an "BIHD1 polypeptide" as defined herein refers to any polypeptide sequence which when used in the construction of a BIHD1 phylogenetic tree, such as the one depicted in FIG. 4, clusters with the clade of BELL-1 homeodomain polypeptides rather than with any other homeodomain polypeptide clade.

Alternatively or additionally, a "BIHD1 polypeptide" as defined herein refers to any polypeptide having in increasing order of preference at least 50%, 55%, 60%, 65%, 70%, 75%, 80%, 85%, 90%, 95%, 98%, 99% or more amino acid sequence identity to any of the polypeptide sequences given in Table A2 herein.

Analysis of the polypeptide sequence of SEQ ID NO: 67 is presented below in Example 4 herein. For example, a BIHD1 polypeptide as represented by SEQ ID NO: 67 comprises a homeobox domain with an InterPro accession IPRO001356, and a POX domain with InterPro accession number IPRO006563, amongst others. Domains may also be identified using routine techniques, such as by sequence alignment. An alignment of the polypeptides of Table A2, is shown in FIG. 6. Such alignments are useful for identifying the most conserved domains between the BIHD1 polypeptides, such as the SKY box, and the VSLTGL box, named after the conserved amino acid residues they comprise.

Concerning MYB30 polypeptides/genes, any reference hereinafter to a "protein useful in the methods of the invention" is taken to mean a MYB30 polypeptide as defined herein. Any reference hereinafter to a "nucleic acid useful in the methods of the invention" is taken to mean a nucleic acid capable of encoding such a MYB30 polypeptide. The nucleic acid to be introduced into a plant (and therefore useful in performing the methods of the invention) is any nucleic acid encoding the type of protein which will now be described, hereafter also named "MYB30 nucleic acid" or "MYB30 gene".

A "MYB30 polypeptide" as defined herein refers to any R2R3MYB polypeptide comprising at least one, preferably two SANT domains (SMART entry SM00717, Myb_DNA-binding domain (Pfam entry PF00249)). In addition, a "MYB30 polypeptide" furthermore comprises one or more of Motifs 9 to 11 preferably Motif 9.

Alternatively, A "MYB30 polypeptide" refers to a polypeptide sequence which when used in the construction of a phylogenetic tree, such as the one depicted in Stracke et al. 2001, clusters within the clade defined by AtMYB60, AtMYB30, AtMYB31, AtMYB96 and AtMYB94 polypeptides comprising the amino acid sequence represented by SEQ ID NO: 91 rather than with any other group.

Motif 9 (SEQ ID NO: 119): QGsLSL[IF]EKWLFd[DE] [x] [SG]; wherein X in position +15 can be any or no amino acid but preferably in increasing order of preference one of S, G, D, Q, A;

Motif 10 (SEQ ID NO: 120): NI[AS][RK][LM]LXG[WF] MK; wherein X in position +7 can be any or no amino acid;

Motif 11 (SEQ ID NO: 121): YASSX[ED];

wherein a single capital letter is given if the relative frequency of a single residue at a certain position is greater than 50% and greater than twice that of the second most frequent residue. When no single residue satisfied these criteria, a pair of residues was assigned as capital letters in brackets if the sum of their relative frequencies exceeded 75%. If neither of these two criteria was fulfilled, a lower-case letter was given if the relative frequency of a residue is greater than 40%. Otherwise, x is given. This consensus sequences follow the criteria of Joshi et al. 1997. Plant Mol Biol 35:993-1001.

Preferably a MYB30 protein useful in the methods of the invention comprises any one of the following:

Motif 9 (SEQ ID NO: 119): QGSLSL[I/F]EKWLFD[D/E]x [S/G]; wherein 1 to 8 amino acids may be substituted by any amino acid.

Motif 10 (SEQ ID NO: 120): NI[A/S][R/K][L/M]LXG[W/F] MK; wherein X is any or no amino acid and wherein 1 to 6 amino acids may be substituted by any amino acid.

Motif 11 (SEQ ID NO: 121): YASSX[ED]; wherein X is any or no amino acid and wherein 1 to 6 amino acids may be substituted by any amino acid.

Preferably MYB30 polypeptides useful in the methods of the invention bind to DNA fragments comprising any one of the Myb DNA-binding motifs well known in the art as for example those described by Jamin et al (1996) Int. J. Quantum Chem. 59, 333-341. (GTAACGGTCTAC); or G[G/T]T [A/T]G[G/T]T (PNAS 93, 14972-14977 (1996)); or GGTTTAG (J. Biol. Chem., Vol. 276, Issue 19, 16511-16519, 2001).

Preferably, the MYB30 protein useful in the methods of the invention comprises a conserved domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid domain set forth in Table C3 of the Examples section or to any of the Motifs 1 to 3; provided that the homologous protein comprises the conserved motifs as outlined above. The sequence identity is determined using an alignment algorithm, such as the Needleman Wunsch algorithm in the program GAP (GCG Wisconsin Package, Accelrys), preferably with default parameters or BLAST.

Alternatively, the homologue of a MYB30 protein has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 89, provided that the homologous protein comprises the conserved motifs as outlined above. The overall sequence identity is determined using a global alignment algorithm, such as the Needleman Wunsch algorithm in the program GAP (GCG Wisconsin Package, Accelrys), preferably with default parameters. Compared to overall sequence identity, the sequence identity will generally be higher when only conserved domains or motifs are considered.

Preferably, the polypeptide sequence which when used in the construction of a phylogenetic tree, such as the one depicted in Stracke et al. 2001, clusters within the clade defined by AtMYB60, AtMYB30, AtMYB31, AtMYB96, AtMYB94 polypeptides comprising the amino acid sequence represented by SEQ ID NO: 91 rather than with any other group.

Concerning THOM polypeptides/genes, any reference hereinafter to a “protein useful in the methods of the invention” is taken to mean a THOM polypeptide as defined herein. Any reference hereinafter to a “nucleic acid useful in the methods of the invention” is taken to mean a nucleic acid capable of encoding such a THOM polypeptide. The nucleic acid to be introduced into a plant (and therefore useful in performing the methods of the invention) is any nucleic acid encoding the type of protein which will now be described, hereafter also named “THOM nucleic acid” or “THOM gene”.

A “THOM polypeptide” as defined herein refers to a Class II HD-Zip transcription factor. Class II HD-Zip transcription factors form a defined group of transcription factors, see for example Sakakibara et al. (2001) or Agalou et al. (2008). A “Class II HD-Zip transcription factor” is taken to mean a transcription factor comprising (i) an “N-terminal HD-ZIP” Leucine zipper domain (ii) a homeobox domain, (iii) a HALZ leucine zipper domain associated with the homeobox domain, and (iv) Motifs 12, 13 and 14 given below (in any order).

```
Motif 12    (SEQ ID NO: 124):    (R/S)(K/R)KLRL
and

Motif 13    (SEQ ID NO: 125):    RQVEVWFQNRRART
                                 KL(K/E)QTEVDCE
and

Motif 14    (SEQ ID NO: 126):    TLXMC(L/P)(S/Q)
                                 C(E/K/R)(R/H)
```

Wherein X in position 3 can be any amino acid, preferably one of A, L, I, or T. Preferably motif 14 is TLTMCPQCER Furthermore, each of motifs 12 to 14 may have a conservative amino acid substitution at any position, examples of conservative substitution are provided in Table 1.

In addition, a THOM polypeptide preferably also comprises one or more of the following motifs:

```
Motif 15    (SEQ ID NO: 127):    SPNS(T/A)

Motif 16    (SEQ ID NO: 128):    LGL

Motif 17    (SEQ ID NO: 129):    (E/D)(E/D)(E/D)

Motif 18    (SEQ ID NO: 130):    (E/Q/D)N(R/K)RL
```

Preferably, motif 18 is ENRRL

The HD-ZIP_N Leucine Zipper domain (Pfam PF04618) is found in the N terminal region of plant homeobox-leucine zipper proteins. Its function is unknown. The homeobox domain (Pfam PF00046) was first identified in a number of *drosophila* homeotic and segmentation proteins. The domain binds DNA through a helix-turn-helix (HTH) structure. The HTH motif is characterised by two alpha-helices, which make intimate contacts with the DNA and are joined by a short turn. The second helix binds to DNA via a number of hydrogen bonds and hydrophobic interactions, which occur between specific side chains and the exposed bases and thymine methyl groups within the major groove of the DNA. The first helix helps to stabilise the structure. The motif is very similar in sequence and structure in a wide range of DNA-binding proteins (e.g., cro and repressor proteins, homeotic proteins, etc.). One of the principal differences between HTH motifs in these different proteins arises from the stereo-chemical requirement for glycine in the turn which is needed to avoid steric interference of the beta-carbon with the main chain: for cro and repressor proteins the glycine appears to be mandatory, while for many of the homeotic and other DNA-binding proteins the requirement is relaxed. The HALZ Leucine Zipper domain (Pfam PF02183) found in THOM polypeptides is a plant specific leucine zipper that is always found associated with a homeobox domain.

Furthermore, Agalou et al., 2008 reported that an intron in helix 2 of the homeodomain in class II HD-zip transcription factors in *Arabidopsis* and rice is not present in class I nor in class III Alternatively, the homologue of a THOM protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 123, provided that the homologous protein comprises the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Preferably, the polypeptide sequence which when used in the construction of a phylogenetic tree, such as the one depicted in FIG. 3 of Sakakibara et al. (2001), clusters within the group of Class II HD-zip transcription factors comprising THOM1 and the amino acid sequence represented by SEQ ID NO: 123 rather than with any other group.

Concerning BIHD2 polypeptides/genes, any reference hereinafter to a "protein useful in the methods of the invention" is taken to mean a BIHD2 polypeptide as defined herein. Any reference hereinafter to a "nucleic acid sequence useful in the methods of the invention" is taken to mean a nucleic acid sequence capable of encoding such a BIHD2 polypeptide. The nucleic acid sequence to be introduced into a plant (and therefore useful in performing the methods of the invention) is any nucleic acid sequence encoding the type of polypeptide, which will now be described, hereafter also named "BIHD2 nucleic acid sequence" or "BIHD2 gene".

A "BIHD2 polypeptide" as defined herein refers to any polypeptide having in increasing order of preference at least 50%, 55%, 60%, 65%, 70%, 75%, 80%, 85%, 90%, 95%, 98%, 99% or more amino acid sequence identity to a BIHD2 polypeptide as represented by SEQ ID NO: 193.

Alternatively or additionally, a "BIHD2 polypeptide" as defined herein refers to any polypeptide comprising: (i) a homeobox domain with an InterPro accession IPRO001356 and (ii) a POX domain with an InterPro accession IPRO06563.

A preferred BIHD2 polypeptide useful in the methods of the invention refers to a polypeptide comprising a domain having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to any of the domains i) a homeobox domain with an InterPro accession IPRO001356; (ii) a POX domain with an InterPro accession IPRO06563 as present in any of the polypeptides of Table A5 of Example 1, preferably as present in SEQ ID NO: 193.

Alternatively or additionally, a "BIHD2 polypeptide" as defined herein refers to any polypeptide having in increasing order of preference at least at least 50 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more amino acid sequence identity to any of the polypeptide sequences given in Table A5 of Example 1 herein.

The terms "domain", "signature" and "motif" are defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Concerning BIHD2 sequences, analysis of the polypeptide sequence of SEQ ID NO: 193 is presented below in Example 4 herein. For example, a BIHD2 polypeptide as represented by SEQ ID NO: 193 comprises a homeobox domain with an InterPro accession IPR0001356, and a POX domain with InterPro accession number IPR0006563, amongst others. Domains may also be identified using routine techniques, such as by sequence alignment. An alignment of the polypeptides of Table A5is shown in FIG. 14. Such alignments are useful for identifying the most conserved domains between the BIHD2 polypeptides, such as the GPFTGY (SEQ ID No: 249) box, the SNWFINARV (SEQ ID No: 250) box, the RGLP (SEQ ID No: 251) box, and the HFLHPYP (SEQ ID No: 252) box, named after the conserved amino acid residues they comprise.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

Concerning B1HD1 sequences, Example 3 herein describes in Table B2 the percentage identity between the BIHD1 polypeptide as represented by SEQ ID NO: 67 and the BIHD1 polypeptides listed in Table A2. The percentage amino acid sequence identity between the BIHD1 polypeptide as represented by SEQ ID NO: 67 and the BIHD1 polypeptides listed in Table A2 is of at least 35%. Amino acid sequence identity outside of the homeobox domain of homeodomain transcription factors is commonly known to be low.

The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others.

Concerning BIHD2 sequences, the prediction of the sub-cellular localisation and topology of a BIHD1 polypeptide as represented by SEQ ID NO: 67 is described in Examples 5 and 6 of the present application.

Concerning BIHD2 sequences, the prediction of the sub-cellular localisation and topology of a BIHD2 polypeptide as represented by SEQ ID NO: 193 is described in Examples 5 and 6 of the present application.

Furthermore, ODC polypeptides (at least in their native form) typically have Ornithine decarboxylase activity. Tools and techniques for measuring Ornithine decarboxylase activity are well known in the art. Further details are provided in Example 8.

In addition, ODC polypeptides, when expressed in rice according to the methods of the present invention as outlined in Examples 9 and 10, give plants having increased yield related traits, in particular on or more of increased biomass, increased early vigour, increased total seed weight, increased number of seeds per plant and increased number of filled seeds.

Furthermore, MYB30 polypeptides typically have DNA-binding activity and an activation domain. A person skilled in the art may easily determine the presence of an activation domain and DNA-binding activity using routine techniques and procedures for example as that described in Xue G P. Plant J. 2005. 41(4):638-49) and references therein. Proteins interacting with MYB30 polypeptides (for example in transcriptional complexes) may easily be identified using standard techniques for a person skilled in the art, such as two-hybrid interaction. It is postulated that MYB30 proteins interact with BHLH transcription factors (Zimmerman et al., Plant Journal 40, 22-34, 2004).

In addition, MYB30 polypeptides, when expressed in rice according to the methods of the present invention as outlined in Examples 9 and 10, give plants having increased yield related traits, in particular increased biomass and/or increased emergence vigour.

Furthermore, THOM polypeptides exhibit the general biological activity of transcription factors (at least in their native form) and typically have DNA-binding activity. Tools and techniques for measuring DNA-binding activity are well known in the art. Sessa et al., (J. Mol. Biol. 274, 303-309, 1997) studied the DNA-binding properties of the ATHB-1 and ATHB-2 (=HAT4) HD-Zip (HD-Zip-1 and -2) domains and found that they interact with DNA as homodimers and recognize two distinct 9 bp pseudopalindromic sequences, CAAT(A/T)ATTG (BS-1) and CAAT(G/C)ATTG (BS-2), respectively. From a mutational analysis of the HD-Zip-2 domain, they determined that conserved amino acid residues of helix 3, Va147 and Asn51, and Arg55 are essential for the DNA-binding activity of the HD-Zip-2 domain. They also report that the preferential recognition of a G/C base-pair at the central position by the HD-Zip-2 domain is abolished either by the replacement of Arg55 with lysine or by the substitution of Glu46 and Thr56 with the corresponding residues of the HD-Zip-1 domain (alanine and tryptophan, respectively). Further details are provided in Example 8.

In addition, THOM polypeptides, when expressed in rice according to the methods of the present invention as outlined in Examples 9, 10 and 11, give plants having increased yield related traits, in particular increased seed yield.

Concerning Ornithin Decarboxylase sequences, the present invention is illustrated by transforming plants with the nucleic acid sequence represented by SEQ ID NO: 1, encoding the polypeptide sequence of SEQ ID NO: 2. However, performance of the invention is not restricted to these sequences; the methods of the invention may advantageously be performed using any ODC-encoding nucleic acid or ODC polypeptide as defined herein.

Concerning Ornithin Decarboxylase sequences, examples of nucleic acids encoding ODC polypeptides are given in Table A1 of Example 1 herein. Such nucleic acids are useful in performing the methods of the invention. The amino acid sequences given in Table A1 of Example 1 are example sequences of orthologues and paralogues of the ODC polypeptide represented by SEQ ID NO: 2, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A1 of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1 or SEQ ID NO: 2, the second BLAST would therefore be against *Nicotiana tabacum* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning BIHD1 sequences, the present invention is illustrated by transforming plants with the nucleic acid sequence represented by SEQ ID NO: 66, encoding the BIHD1 polypeptide sequence of SEQ ID NO: 67. However, performance of the invention is not restricted to these sequences; the methods of the invention may advantageously be performed using any nucleic acid sequence encoding a BIHD1 polypeptide as defined herein.

Concerning BIHD1 sequences, examples of nucleic acid sequences encoding BIHD1 polypeptides are given in Table A2 of Example 1 herein. Such nucleic acid sequences are useful in performing the methods of the invention. The polypeptide sequences given in Table A2 of Example 1 are example sequences of orthologues and paralogues of the BIHD1 polypeptide represented by SEQ ID NO: 67, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A2 of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 66 or SEQ ID NO: 67, the second BLAST would therefore be against *Oryza* sative sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning MYB30 sequences, the present invention is illustrated by transforming plants with the nucleic acid sequence represented by SEQ ID NO: 88, encoding the polypeptide sequence of SEQ ID NO: 89. However, performance of the invention is not restricted to these sequences; the methods of the invention may advantageously be performed using any MYB30-encoding nucleic acid or MYB30 polypeptide as defined herein.

Concerning MYB30 sequences, examples of nucleic acids encoding MYB30 polypeptides are given in Table A3 of Example 1 herein. Such nucleic acids are useful in performing the methods of the invention. The amino acid sequences given in Table A3 of Example 1 are example sequences of orthologues and paralogues of the MYB30 polypeptide represented by SEQ ID NO: 89, the terms “orthologues” and “paralogues” being as defined herein. Further orthologues and paralogues may readily be identified by performing a so-called reciprocal blast search. Typically, this involves a first BLAST involving BLASTing a query sequence (for example using any of the sequences listed in Table A3 of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 88 or SEQ ID NO: 89, the second BLAST would therefore be against *Arabidopsis thaliana* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning THOM sequences, the present invention is illustrated by transforming plants with the nucleic acid sequence represented by SEQ ID NO: 122, encoding the polypeptide sequence of SEQ ID NO: 123. However, performance of the invention is not restricted to these sequences; the methods of the invention may advantageously be performed using any THOM-encoding nucleic acid or THOM polypeptide as defined herein.

Examples of nucleic acids encoding THOM polypeptides are given in Table A4 of Example 1 herein. Such nucleic acids are useful in performing the methods of the invention. The amino acid sequences given in Table A4 of The Examples section are example sequences of orthologues and paralogues of the THOM polypeptide represented by SEQ ID NO: 123, the terms “orthologues” and “paralogues” being as defined herein. Further orthologues and paralogues may readily be identified by performing a so-called reciprocal blast search. Typically, this involves a first BLAST involving BLASTing a query sequence (for example using any of the sequences listed in Table A4 of The Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 122 or SEQ ID NO: 123, the second BLAST would therefore be against *Solanum Lycopersicum* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning BIHD2 sequences, the present invention is illustrated by transforming plants with the nucleic acid sequence represented by SEQ ID NO: 192, encoding the BIHD2 polypeptide sequence of SEQ ID NO: 193. However, performance of the invention is not restricted to these sequences; the methods of the invention may advantageously be performed using any nucleic acid sequence encoding a BIHD2 polypeptide as defined herein.

Examples of nucleic acid sequences encoding BIHD2 polypeptides are given in Table A5 of Example 1 herein. Such nucleic acid sequences are useful in performing the methods of the invention. The polypeptide sequences given in Table A5 of Example 1 are example sequences of orthologues and paralogues of the BIHD2 polypeptide represented by SEQ ID NO: 193, the terms “orthologues” and “paralogues” being as defined herein. Further orthologues and paralogues may readily be identified by performing a so-called reciprocal blast search. Typically, this involves a first BLAST involving BLASTing a query sequence (for example using any of the sequences listed in Table A5 of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 192 or SEQ ID NO: 193, the second BLAST would therefore be against *Medicago sativa* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acid sequences encoding homologues and derivatives of any one of the polypeptide sequences given in Table A1-A5 of Example 1, the terms "homologue" and "derivative" being as defined herein. Also useful in the methods of the invention are nucleic acid sequences encoding homologues and derivatives of orthologues or paralogues of any one of the polypeptide sequences given in Table A1-A5 of Example 1. Homologues and derivatives useful in the methods of the present invention have substantially the same biological and functional activity as the unmodified protein from which they are derived.

Further nucleic acid variants useful in practising the methods of the invention include portions of nucleic acids sequences encoding ODC polypeptides, or BIHD1 polypeptides, or MYB30 polypeptides, or THOM polypeptides, or BIHD2 polypeptides, nucleic acids hybridising to nucleic acids encoding ODC polypeptides, or BIHD1 polypeptides, or MYB30 polypeptides, or THOM polypeptides, or BIHD2 polypeptides, splice variants of nucleic acids encoding ODC polypeptides, or BIHD1 polypeptides, or MYB30 polypeptides, or THOM polypeptides, or BIHD2 polypeptides, allelic variants of nucleic acids encoding ODC polypeptides and variants of nucleic acids encoding ODC polypeptides, or BIHD1 polypeptides, or MYB30 polypeptides, or THOM polypeptides, or BIHD2 polypeptides, obtained by gene shuffling. The terms hybridising sequence, splice variant, allelic variant and gene shuffling are as described herein.

Nucleic acids encoding ODC polypeptides, or BIHD1 polypeptides, or MYB30 polypeptides, or THOM polypeptides, or BIHD2 polypeptides, need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table A1-A5 of Example 1, or a portion of a nucleic acid encoding an orthologue, paralogue or homologue of any of the amino acid sequences given in Table A1-A5 of Example 1.

A portion of a nucleic acid sequence may be prepared, for example, by making one or more deletions to the nucleic acid sequence. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Concerning ODC polypeptides, portions useful in the methods of the invention, encode an ODC polypeptide as defined herein, and have substantially the same biological activity as the amino acid sequences given in Table A1 of Example 1. Preferably, the portion is a portion of any one of the nucleic acids given in Table A1 of Example 1, or is a portion of a nucleic acid encoding an orthologue or paralogue of any one of the amino acid sequences given in Table A1 of Example 1. Preferably the portion is at least 200, 300, 400, 500, 550, 600, 650, 700, 750, 800, 850, 900, 950, 1000, 1500 consecutive nucleotides in length, the consecutive nucleotides being of any one of the nucleic acid sequences given in Table A1 of Example 1, or of a nucleic acid encoding an orthologue or paralogue of any one of the amino acid sequences given in Table A1 of Example 1. Most preferably the portion is a portion of the nucleic acid of SEQ ID NO: 1. Preferably, the portion encodes a fragment of an amino acid sequence which, when used in the construction of a phylogenetic tree, such as the one depicted in FIG. 2, clusters preferably with the group of ODC polypeptides, most preferably with the group comprising the amino acid sequence represented by SEQ ID NO: 2 rather than with any other group.

Concerning BIHD1 polypeptides, portions useful in the methods of the invention, encode a BIHD1 polypeptide as defined herein, and have substantially the same biological activity as the polypeptide sequences given in Table A2 of Example 1. Preferably, the portion is a portion of any one of the nucleic acid sequences given in Table A2 of Example 1, or is a portion of a nucleic acid sequence encoding an orthologue or paralogue of any one of the polypeptide sequences given in Table A2 of Example 1. Preferably the portion is, in increasing order of preference at least 1300, 1350, 1400, 1450, 1500, 1550, 1600, 1650, 1700, 1750, 1800, 1850, 1900, 1925, or more consecutive nucleotides in length, the consecutive nucleotides being of any one of the nucleic acid sequences given in Table A2 of Example 1, or of a nucleic acid sequence encoding an orthologue or paralogue of any one of the polypeptide sequences given in Table A2 of Example 1. Preferably, the portion is a portion of a nucleic sequence encoding a polypeptide sequence having in increasing order of preference at least 50%, 55%, 60%, 65%, 70%, 75%, 80%, 85%, 90%, 95%, 98%, 99% or more amino acid sequence identity to a BIHD1 polypeptide as represented by SEQ ID NO: 67. More preferably, the portion is a portion of the nucleic acid sequence as represented by SEQ ID NO: 66.

Concerning MYB30 polypeptides, portions useful in the methods of the invention, encode a MYB30 polypeptide as defined herein, and have substantially the same biological activity as the amino acid sequences given in Table A3 of Example 1. Preferably, the portion is a portion of any one of the nucleic acids given in Table A3 of Example 1, or is a portion of a nucleic acid encoding an orthologue or paralogue of any one of the amino acid sequences given in Table A3 of Example 1. Preferably the portion is at least 400, 500, 550, 600, 650, 700, 750, 800, 850, 900, 950, 1000 consecutive nucleotides in length, the consecutive nucleotides being of any one of the nucleic acid sequences given in Table A3 of Example 1, or of a nucleic acid encoding an orthologue or paralogue of any one of the amino acid sequences given in Table A3 of Example 1. Most preferably the portion is a portion of the nucleic acid of SEQ ID NO: 88.

Concerning MYB30 polypeptides, preferably, the portion encodes a fragment of an amino acid sequence which, when used in the construction of a phylogenetic tree, such as the one depicted in Stracke et al. 2001, clusters within the clade defined by AtMYB60, AtMYB30, AtMYB31, AtMYB96, AtMYB94 polypeptides comprising the amino acid sequence represented by SEQ ID NO: 91 rather than with any other group.

Concerning THOM polypeptides, portions useful in the methods of the invention, encode a THOM polypeptide as defined herein, and have substantially the same biological activity as the amino acid sequences given in Table A4 of Example 1. Preferably, the portion is a portion of any one of the nucleic acids given in Table A4 of Example 1, or is a portion of a nucleic acid encoding an orthologue or paralogue of any one of the amino acid sequences given in Table A4 of Example 1. Preferably the portion is at least 500, 550, 600, 650, 700, 750, 800, 850, 900, 950, 1000, 1050, 1100, 1150, 1200 consecutive nucleotides in length, the consecutive nucleotides being of any one of the nucleic acid sequences given in Table A4 of Example 1, or of a nucleic acid encoding an orthologue or paralogue of any one of the amino acid sequences given in Table A4 of Example 1. Most preferably the portion is a portion of the nucleic acid of SEQ ID NO: 122. Preferably, the portion encodes a fragment of an amino acid sequence which when used in the construction of a phylogenetic tree, such as the one depicted in FIG. 3 of Sakakibara et al. (2001), clusters within the group of Class II HD-zip transcription factors comprising THOM1 and the amino acid sequence represented by SEQ ID NO: 123 rather than with any other group.

Portions useful in the methods of the invention, encode a BIHD2 polypeptide as defined herein, and have substantially the same biological activity as the polypeptide sequences given in Table A5 of Example 1. Preferably, the portion is a portion of any one of the nucleic acid sequences given in Table A5 of Example 1, or is a portion of a nucleic acid sequence encoding an orthologue or paralogue of any one of the polypeptide sequences given in Table A5 of Example 1. Preferably the portion is, in increasing order of preference at least 20, 50, 100, 200, 300, 400, 500, 600, 700, 800, 900, 1000, 1100, 1200, 1300, 1350, 1400, 1450, 1500, 1550, 1600, 1650, 1700, 1750, 1800, 1850, 1900, 1925, or more consecutive nucleotides in length, the consecutive nucleotides being of any one of the nucleic acid sequences given in Table A5 of Example 1, or of a nucleic acid sequence encoding an orthologue or paralogue of any one of the polypeptide sequences given in Table A5 of Example 1. Preferably, the portion is a portion of a nucleic sequence encoding a polypeptide sequence having in increasing order of preference at least 50%, 55%, 60%, 65%, 70%, 75%, 80%, 85%, 90%, 95%, 98%, 99% or more amino acid sequence identity to a BIHD2 polypeptide as represented by SEQ ID NO: 193. More preferably, the portion is a portion of the nucleic acid sequence as represented by SEQ ID NO: 192.

Another nucleic acid sequence variant useful in the methods of the invention is a nucleic acid sequence capable of hybridising, under reduced stringency conditions, preferably under stringent conditions, with a nucleic acid sequence encoding an ODC polypeptide, or a BIHD1 polypeptide, or a MYB30 polypeptide, or a THOM polypeptide, or a BIHD2 polypeptide as defined herein, or with a portion as defined herein.

According to the present invention, there is provided a method for increasing yield-related traits in plants, comprising introducing and expressing in a plant a nucleic acid sequence capable of hybridizing to any one of the nucleic acid sequences given in Table A1-A5 of Example 1, or comprising introducing and expressing in a plant a nucleic acid sequence capable of hybridising to a nucleic acid sequence encoding an orthologue, paralogue or homologue of any of the nucleic acid sequences given in Table A1-A5 of Example 1.

Concerning ODC polypeptides, hybridising sequences useful in the methods of the invention encode an ODC polypeptide as defined herein, having substantially the same biological activity as the amino acid sequences given in Table A1 of Example 1. Preferably, the hybridising sequence is capable of hybridising to any one of the nucleic acids sequences given in Table A1 of Example 1, or to a portion of any of these sequences, a portion being as defined above, or the hybridising sequence is capable of hybridising to a nucleic acid sequence encoding an orthologue or paralogue of any one of the amino acid sequences given in Table A1 of Example 1. Most preferably, the hybridising sequence is capable of hybridising to a nucleic acid as represented by SEQ ID NO: 1 or to a portion thereof. Preferably, the hybridising sequence encodes a polypeptide with an amino acid sequence which, when full-length and used in the construction of a phylogenetic tree, such as the one depicted in FIG. 2, clusters preferably with the group of ODC polypeptides, most preferably with the group comprising the amino acid sequence represented by SEQ ID NO: 2 rather than with any other group.

Concerning BIHD1 polypeptides, hybridising sequences useful in the methods of the invention encode a BIHD1 polypeptide as defined herein, and have substantially the same biological activity as the polypeptide sequences given in Table A2 of Example 1. Preferably, the hybridising sequence is capable of hybridising to any one of the nucleic acid sequences given in Table A2 of Example 1, or to a portion of any of these sequences, a portion being as defined above, or wherein the hybridising sequence is capable of hybridising to a nucleic acid sequence encoding an orthologue or paralogue of any one of the polypeptide sequences given in Table A2 of Example 1. Preferably, the hybridising sequence is capable of hybridising to a nucleic acid sequence encoding a polypeptide sequence having in increasing order of preference at least 50%, 55%, 60%, 65%, 70%, 75%, 80%, 85%, 90%, 95%, 98%, 99% or more amino acid sequence identity to a BIHD1 polypeptide as represented by SEQ ID NO: 67. Most preferably, the hybridising sequence is capable of hybridising to a nucleic acid sequence as represented by SEQ ID NO: 66 or to a portion thereof.

Concerning MYB30 polypeptides, hybridising sequences useful in the methods of the invention encode a MYB30 polypeptide as defined herein, having substantially the same biological activity as the amino acid sequences given in Table A3 of Example 1. Preferably, the hybridising sequence is capable of hybridising to the complement of any one of the nucleic acids given in Table A3 of Example 1, or to a portion of any of these sequences, a portion being as defined above, or the hybridising sequence is capable of hybridising to the complement of a nucleic acid encoding an orthologue or paralogue of any one of the amino acid sequences given in Table A3 of Example 1. Most preferably, the hybridising sequence is capable of hybridising to the complement of a nucleic acid as represented by SEQ ID NO: 88 or to a portion thereof.

Concerning MYB30 polypeptides, preferably, the hybridising sequence encodes a polypeptide with an amino acid sequence which, when full-length and used in the construction of a phylogenetic tree, such as the one depicted in Stracke et al. 2001, clusters within the clade defined by AtMYB60, AtMYB30, AtMYB31, AtMYB96, AtMYB94 polypeptides comprising the amino acid sequence represented by SEQ ID NO: 91 rather than with any other group.

Concerning THOM polypeptides, hybridising sequences useful in the methods of the invention encode a THOM polypeptide as defined herein, having substantially the same biological activity as the amino acid sequences given in Table A4 of Example 1. Preferably, the hybridising sequence is capable of hybridising to the complement of any one of the nucleic acids given in Table A4 of Example 1, or to a portion of any of these sequences, a portion being as defined above, or the hybridising sequence is capable of hybridising to the complement of a nucleic acid encoding an orthologue or paralogue of any one of the amino acid sequences given in Table A4 of Example 1. Most preferably, the hybridising sequence is capable of hybridising to the complement of a nucleic acid as represented by SEQ ID NO: 122 or to a portion thereof.

Concerning THOM polypeptides, preferably, the hybridising sequence encodes a polypeptide with an amino acid sequence which when used in the construction of a phylogenetic tree, such as the one depicted in FIG. 3 of Sakakibara et al. (2001), clusters within the group of Class II HD-zip transcription factors comprising THOM1 and the amino acid sequence represented by SEQ ID NO: 123 rather than with any other group.

Concerning BIHD2 sequences, hybridising sequences useful in the methods of the invention encode a BIHD2 polypeptide as defined herein, and have substantially the same biological activity as the polypeptide sequences given in Table A5 of Example 1.

Preferably, the hybridising sequence is capable of hybridising to any one of the nucleic acid sequences given in Table A5 of Example 1, or to a portion of any of these sequences, a portion being as defined above, or wherein the hybridising sequence is capable of hybridising to a nucleic acid sequence encoding an orthologue or paralogue of any one of the polypeptide sequences given in Table A5 of Example 1. Preferably, the hybridising sequence is capable of hybridising to a nucleic acid sequence encoding a polypeptide sequence having in increasing order of preference at least 50%, 55%, 60%, 65%, 70%, 75%, 80%, 85%, 90%, 95%, 98%, 99% or more amino acid sequence identity to a BIHD2 polypeptide as represented by SEQ ID NO: 193. Most preferably, the hybridising sequence is capable of hybridising to a nucleic acid sequence as represented by SEQ ID NO: 192 or to a portion thereof.

Another nucleic acid sequence variant useful in the methods of the invention is a splice variant encoding an ODC polypeptide, or a BIHD1 polypeptide, or a MYB30 polypeptide, or a THOM polypeptide, or a BIHD2 polypeptide as defined hereinabove, a splice variant being as defined herein.

According to the present invention, there is provided a method for enhancing and/or increasing yield-related traits in plants, comprising introducing and expressing in a plant a splice variant of any one of the nucleic acid sequences given in Table A1-A5 of Example 1, or a splice variant of a nucleic acid encoding an orthologue, paralogue or homologue of any of the amino acid sequences given in Table A1-A5 of Example 1.

Concerning ODC polypeptides, preferred splice variants are splice variants of a nucleic acid represented by SEQ ID NO: 1, or a splice variant of a nucleic acid encoding an orthologue or paralogue of SEQ ID NO: 2. Preferably, the amino acid sequence encoded by the splice variant, when used in the construction of a phylogenetic tree, such as the one depicted in FIG. 2, clusters preferably with the group of ODC polypeptides, most preferably with the group comprising the amino acid sequence represented by SEQ ID NO: 2 rather than with any other group.

Concerning BIHD1 polypeptides, preferred splice variants are splice variants of a nucleic acid sequence represented by SEQ ID NO: 66, or a splice variant of a nucleic acid sequence encoding an orthologue or paralogue of SEQ ID NO: 67. Preferably, the splice variant is a splice variant of a nucleic acid sequence encoding a polypeptide sequence having in increasing order of preference at least 50%, 55%, 60%, 65%, 70%, 75%, 80%, 85%, 90%, 95%, 98%, 99% or more amino acid sequence identity to a BIHD1 polypeptide as represented by SEQ ID NO: 67.

Concerning MYB30 polypeptides, preferred splice variants are splice variants of a nucleic acid represented by SEQ ID NO: 88, or a splice variant of a nucleic acid encoding an orthologue or paralogue of SEQ ID NO: 89. Preferably, the amino acid sequence encoded by the splice variant, when used in the construction of a phylogenetic tree, such as the one depicted in Stracke et al. 2001, clusters within the clade defined by AtMYB60, AtMYB30, AtMYB31, AtMYB96, AtMYB94 polypeptides comprising the amino acid sequence represented by SEQ ID NO: 91 rather than with any other group.

Concerning THOM polypeptides, preferred splice variants are splice variants of a nucleic acid represented by SEQ ID NO: 1, or a splice variant of a nucleic acid encoding an orthologue or paralogue of SEQ ID NO: 2. Preferably, the amino acid sequence encoded by the splice variant, when used in the construction of a phylogenetic tree, such as the one depicted in FIG. 3 of Sakakibara et al. (2001), clusters within the group of Class II HD-zip transcription factors comprising THOM1 and the amino acid sequence represented by SEQ ID NO: 123 rather than with any other group.

Concering BIHD2 sequences, preferred splice variants are splice variants of a nucleic acid sequence represented by SEQ ID NO: 192, or a splice variant of a nucleic acid sequence encoding an orthologue or paralogue of SEQ ID NO: 193. Preferably, the splice variant is a splice variant of a nucleic acid sequence encoding a polypeptide sequence having in increasing order of preference at least 50%, 55%, 60%, 65%, 70%, 75%, 80%, 85%, 90%, 95%, 98%, 99% or more amino acid sequence identity to a BIHD2 polypeptide as represented by SEQ ID NO: 193.

Another nucleic acid sequence variant useful in performing the methods of the invention is an allelic variant of a nucleic acid sequence encoding an ODC polypeptide, or a BIHD1 polypeptide, or a MYB30 polypeptide, or a THOM polypeptide, or a BIHD2 polypeptide as defined hereinabove, an allelic variant being as defined herein.

According to the present invention, there is provided a method for increasing yield-related traits, comprising introducing and expressing in a plant an allelic variant of any one of the nucleic acid sequences given in Table A1-A5 of Example 1, or comprising introducing and expressing in a plant an allelic variant of a nucleic acid sequence encoding an orthologue, paralogue or homologue of any of the polypeptide sequences given in Table A1-A5 of Example 1.

Concerning ODC polypeptides, the polypeptides encoded by allelic variants useful in the methods of the present invention have substantially the same biological activity as the ODC polypeptide of SEQ ID NO: 2 and any of the amino acids depicted in Table A1 of Example 1. Allelic variants exist in nature, and encompassed within the methods of the present invention is the use of these natural alleles. Preferably, the allelic variant is an allelic variant of SEQ ID NO: 1 or an allelic variant of a nucleic acid encoding an orthologue or paralogue of SEQ ID NO: 2. Preferably, the amino acid sequence encoded by the allelic variant, when used in the construction of a phylogenetic tree, such as the one depicted in FIG. 2, clusters preferably with the group of ODC polypeptides, most preferably with the group comprising the amino acid sequence represented by SEQ ID NO: 2 rather than with any other group.

Concerning BIHD1 polypeptides, the allelic variants useful in the methods of the present invention have substantially the same biological activity as the BIHD1 polypeptide of SEQ ID NO: 67 and any of the polypeptide sequences depicted in Table A2 of Example 1. Allelic variants exist in nature, and encompassed within the methods of the present invention is the use of these natural alleles. Preferably, the allelic variant is an allelic variant of SEQ ID NO: 66 or an allelic variant of a nucleic acid sequence encoding an orthologue or paralogue of SEQ ID NO: 67. Preferably, the allelic variant is an allelic variant of a polypeptide sequence having in increasing order of preference at least 50%, 55%, 60%, 65%, 70%, 75%, 80%, 85%, 90%, 95%, 98%, 99% or more amino acid sequence identity to a BIHD1 polypeptide as represented by SEQ ID NO: 67.

Concerning MYB30 polypeptides, the polypeptides encoded by allelic variants useful in the methods of the present invention have substantially the same biological activity as the MYB30 polypeptide of SEQ ID NO: 89 and any of the amino acids depicted in Table A3 of Example 1. Allelic variants exist in nature, and encompassed within the methods of the present invention is the use of these natural alleles. Preferably, the allelic variant is an allelic variant of SEQ ID NO: 88 or an allelic variant of a nucleic acid encoding an orthologue or paralogue of SEQ ID NO: 89. Preferably, the amino acid sequence encoded by the allelic variant, when used in the construction of a phylogenetic tree, such as the one depicted in Stracke et al. 2001, clusters within the clade defined by AtMYB60, AtMYB30, AtMYB31, AtMYB96, AtMYB94 polypeptides comprising the amino acid sequence represented by SEQ ID NO: 91 rather than with any other group.

Concerning THOM polypeptides, the polypeptides encoded by allelic variants useful in the methods of the present invention have substantially the same biological activity as the THOM polypeptide of SEQ ID NO: 123 and any of the amino acids depicted in Table A4 of Example 1. Allelic variants exist in nature, and encompassed within the methods of the present invention is the use of these natural alleles. Preferably, the allelic variant is an allelic variant of SEQ ID NO: 122 or an allelic variant of a nucleic acid encoding an orthologue or paralogue of SEQ ID NO: 123. Preferably, the amino acid sequence encoded by the allelic variant, when used in the construction of a phylogenetic tree, such as the one depicted in FIG. 13 of Sakakibara et al. (2001), clusters within the group of Class II HD-zip transcription factors comprising THOM1 and the amino acid sequence represented by SEQ ID NO: 123 rather than with any other group.

Concerning the BIHD2, the allelic variants useful in the methods of the present invention have substantially the same biological activity as the BIHD2 polypeptide of SEQ ID NO: 193 and any of the polypeptide sequences depicted in Table A5 of Example 1. Allelic variants exist in nature, and encompassed within the methods of the present invention is the use of these natural alleles. Preferably, the allelic variant is an allelic variant of SEQ ID NO: 192 or an allelic variant of a nucleic acid sequence encoding an orthologue or paralogue of SEQ ID NO: 193. Preferably, the allelic variant is an allelic variant of a polypeptide sequence having in increasing order of preference at least 50%, 55%, 60%, 65%, 70%, 75%, 80%, 85%, 90%, 95%, 98%, 99% or more amino acid sequence identity to a BIHD2 polypeptide as represented by SEQ ID NO: 193.

Gene shuffling or directed evolution may also be used to generate variants of nucleic acid sequences encoding ODC polypeptides, or BIHD1 polypeptides, or MYB30 polypeptides, or THOM polypeptides, or BIHD2 polypeptides as defined above, the term "gene shuffling" being as defined herein.

According to the present invention, there is provided a method for enhancing and/or increasing yield-related traits, comprising introducing and expressing in a plant a variant of any one of the nucleic acid sequences given in Table A1-A5 of Example 1, or comprising introducing and expressing in a plant a variant of a nucleic acid sequence encoding an orthologue, paralogue or homologue of any of the polypeptide sequences given in Table A1-A5 of Example 1, which variant nucleic acid sequence is obtained by gene shuffling.

Concerning ODC polypeptides, preferably, the amino acid sequence encoded by the variant nucleic acid sequence obtained by gene shuffling, when used in the construction of a phylogenetic tree such as the one depicted in FIG. 2, clusters preferably with the group of ODC polypeptides, most preferably with the group comprising the amino acid sequence represented by SEQ ID NO: 2 rather than with any other group.

Concerning BIHD1 polypeptides, preferably, the variant nucleic acid sequence obtained by gene shuffling encodes a polypeptide sequence having in increasing order of preference at least 50%, 55%, 60%, 65%, 70%, 75%, 80%, 85%, 90%, 95%, 98%, 99% or more amino acid sequence identity to a BIHD1 polypeptide as represented by SEQ ID NO: 67.

Concerning MYB30 polypeptides, preferably, the amino acid sequence encoded by the variant nucleic acid obtained by gene shuffling, when used in the construction of a phylogenetic tree such as the one depicted in Stracke et al. 2001, clusters within the clade defined by AtMYB60, AtMYB30, AtMYB31, AtMYB96, AtMYB94 polypeptides comprising the amino acid sequence represented by SEQ ID NO: 91 rather than with any other group.

Concerning THOM polypeptides, preferably, the amino acid sequence encoded by the variant nucleic acid obtained by gene shuffling, when used in the construction of a phylogenetic tree, such as the one depicted in FIG. 3 of Sakakibara et al. (2001), clusters within the group of Class II HD-zip transcription factors comprising THOM1 and the amino acid sequence represented by SEQ ID NO: 123 rather than with any other group.

Preferably, the variant nucleic acid sequence obtained by gene shuffling encodes a polypeptide sequence having in increasing order of preference at least 50%, 55%, 60%, 65%, 70%, 75%, 80%, 85%, 90%, 95%, 98%, 99% or more amino acid sequence identity to a BIHD2 polypeptide as represented by SEQ ID NO: 193.

Furthermore, nucleic acid sequence variants may also be obtained by site-directed mutagenesis. Several methods are available to achieve site-directed mutagenesis, the most common being PCR based methods (Current Protocols in Molecular Biology, Wiley Eds).

Nucleic acid sequences encoding ODC polypeptides may be derived from any natural or artificial source. The nucleic acid may be modified from its native form in composition and/or genomic environment through deliberate human manipulation. Preferably the ODC polypeptide-encoding nucleic acid is from a plant, further preferably from a dicocotyledonous plant, more preferably from the family Solanaceae, most preferably the nucleic acid is from *Nicotiana tabacum*.

Nucleic acid sequences encoding BIHD1 polypeptides may be derived from any natural or artificial source. The nucleic acid sequence may be modified from its native form in composition and/or genomic environment through deliberate human manipulation. The BIHD1 polypeptide-encoding nucleic acid sequence is from the Eukaryota domain, preferably from a plant, further preferably from a monocotyledonous plant, more preferably from the family Poaceae, most preferably the nucleic acid sequence is from *Oryza sativa.*

Nucleic acid sequences encoding MYB30 polypeptides may be derived from any natural or artificial source. The nucleic acid may be modified from its native form in composition and/or genomic environment through deliberate human manipulation. Preferably the MYB30 polypeptide-encoding nucleic acid is from a plant, further preferably from a dicotyledonous plant, more preferably from the family Brassicaceae, most preferably the nucleic acid is from *Arabidopsis thaliana.*

Nucleic acids encoding THOM polypeptides may be derived from any natural or artificial source. The nucleic acid may be modified from its native form in composition and/or genomic environment through deliberate human manipulation. Preferably the THOM polypeptide-encoding nucleic acid is from a plant, further preferably from a dicotyledonous plant, more preferably from the family Solanaceae, most preferably the nucleic acid is from *Solanum Lycopersicum.*

Nucleic acid sequences encoding BIHD2 polypeptides may be derived from any natural or artificial source. The nucleic acid sequence may be modified from its native form in composition and/or genomic environment through deliberate human manipulation. The nucleic acid sequence encoding a BIHD2 polypeptide is from the Eukaryota domain, preferably from a plant, further preferably from a monocotyledonous plant, more preferably from the family Poaceae, most preferably the nucleic acid sequence is from *Oryza sativa.*

Performance of the methods of the invention gives plants having enhanced and/or increased yield-related traits relative to control plants. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants.

Taking corn as an example, a yield increase may be manifested as one or more of the following: increase in the number of plants established per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per hectare or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression in a plant of a nucleic acid sequence encoding an ODC polypeptide, or a MYB30 polypeptide, or a THOM polypeptide as defined herein.

The present invention also provides a method for increasing yield-related traits of plants relative to control plants, which method comprises increasing expression in a plant of a nucleic acid sequence encoding a BIHD1 polypeptide, or a BIHD2 polypeptide as defined herein.

Since the transgenic plants according to the present invention have increased yield and/or yield-related traits, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced and/or increased (early) vigour. The increase in growth rate may alter the harvest cycle of a plant allowing plants to be sown later and/or harvested sooner than would otherwise be possible (a similar effect may be obtained with earlier flowering time; delayed flowering is usually not a desired trait in crops). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises increasing and/or modulating expression in a plant of a nucleic acid sequence encoding an ODC polypeptide, or a BIHD1 polypeptide, or a MYB30 polypeptide, or aTHOM polypeptide, or a BIHD2 polypeptide as defined herein.

An increase in yield and/or growth rate occurs whether the plant is under non-stress conditions or whether the plant is exposed to various stresses compared to control plants grown under comparable conditions. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes, and insects. The term "non-stress" conditions as used herein are those environmental conditions that allow optimal growth of plants. Persons skilled in the art are aware of normal soil conditions and climatic conditions for a given location.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants grown under optimal growth conditions, (grown under non-stress conditions) typically yield in increasing order of preference at least 97%, 95%, 92%, 90%, 87%, 85%, 83%, 80%, 77% or 75% of the average production of such plant in any given environment. Average production may be calculated on harvest and/or season basis. Persons skilled in the art are aware of average yield productions of a crop.

Concerning ODC sequences, performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding an ODC polypeptide.

Concerning BIHD1 sequences, performance of the methods of the invention gives plants grown under non-stress conditions or under mild stress conditions having increased yield-related traits, relative to control plants grown under comparable conditions. Therefore, according to the present invention, there is provided a method for increasing yield-related traits in plants grown under non-stress conditions or under mild stress conditions, which method comprises increasing expression in a plant of a nucleic acid sequence encoding a BIHD1 polypeptide.

Concerning MYB30 sequences, performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding a MYB30 polypeptide.

Concerning THOM sequences, performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding a THOM polypeptide.

Concerning BIHD2 sequences, performance of the methods of the invention gives plants grown under non-stress conditions or under mild stress conditions give them increased yield-related traits, relative to control plants grown under comparable conditions. Therefore, according to the present invention, there is provided a method for increasing yield-related traits in plants grown under non-stress conditions or under mild stress conditions, which method comprises increasing expression in a plant of a nucleic acid sequence encoding a BIHD2 polypeptide.

Concerning ODC sequences, performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding an ODC polypeptide. Nutrient deficiency may result from a lack of nutrients such as nitrogen, phosphates and other phosphorous-containing compounds, potassium, calcium, cadmium, magnesium, manganese, iron and boron, amongst others.

Concerning BIHD1 sequences, performance of the methods according to the present invention results in plants grown under abiotic stress conditions having increased yield-related traits relative to control plants grown under comparable stress conditions. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. Since diverse environmental stresses activate similar pathways, the exemplification of the present invention with drought stress should not be seen as a limitation to drought stress, but more as a screen to indicate the involvement of BIHD1 polypeptides as defined above, in increasing yield-related traits relative to control plants grown in comparable stress conditions, in abiotic stresses in general.

Concerning BIHD1 sequences, performance of the methods of the invention gives plants having increased yield-related traits, under abiotic stress conditions relative to control plants grown in comparable stress conditions. Therefore, according to the present invention, there is provided a method for increasing yield-related traits, in plants grown under abiotic stress conditions, which method comprises increasing expression in a plant of a nucleic acid sequence encoding a BIHD1 polypeptide. According to one aspect of the invention, the abiotic stress is an osmotic stress, selected from one or more of the following: water stress, salt stress, oxidative stress and ionic stress.

The term "abiotic stress" as defined herein is taken to mean any one or more of: water stress (due to drought or excess water), anaerobic stress, salt stress, temperature stress (due to hot, cold or freezing temperatures), chemical toxicity stress and oxidative stress. According to one aspect of the invention, the abiotic stress is an osmotic stress, selected from water stress, salt stress, oxidative stress and ionic stress. Preferably, the water stress is drought stress. The term salt stress is not restricted to common salt (NaCl), but may be any stress caused by one or more of: NaCl, KCl, LiCl, $MgCl_2$, $CaCl_2$, amongst others.

Another example of abiotic environmental stress is the reduced availability of one or more nutrients that need to be assimilated by the plants for growth and development. Because of the strong influence of nutrition utilization efficiency on plant yield and product quality, a huge amount of fertilizer is poured onto fields to optimize plant growth and quality. Productivity of plants ordinarily is limited by three primary nutrients, phosphorous, potassium and nitrogen, which is usually the rate-limiting element in plant growth of these three. Therefore the major nutritional element required for plant growth is nitrogen (N). It is a constituent of numerous important compounds found in living cells, including amino acids, proteins (enzymes), nucleic acids, and chlorophyll. 1.5% to 2% of plant dry matter is nitrogen and approximately 16% of total plant protein. Thus, nitrogen availability is a major limiting factor for crop plant growth and production (Frink et al. (1999) Proc Natl Acad Sci USA 96(4): 1175-1180), and has as well a major impact on protein accumulation and amino acid composition. Therefore, of great interest are crop plants with increased yield-related traits, when grown under nitrogen-limiting conditions.

Performance of the methods of the invention gives plants grown under conditions of reduced nutrient availability, particularly under conditions of reduced nitrogen availablity, having increased yield-related traits relative to control plants grown under comparable conditions. Therefore, according to the present invention, there is provided a method for increasing yield-related traits in plants grown under conditions of reduced nutrient availablity, preferably reduced nitrogen availability, which method comprises increasing expression in a plant of a nucleic acid sequence encoding a BIHD1 polypeptide. Reduced nutrient availability may result from a deficiency or excess of nutrients such as nitrogen, phosphates and other phosphorous-containing compounds, potassium, calcium, cadmium, magnesium, manganese, iron and boron, amongst others. Preferably, reduced nutrient availablity is reduced nitrogen availability.

Concerning MYB30 sequences, performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a MYB30 polypeptide. Nutrient deficiency may result from a lack of nutrients such as nitrogen, phosphates and other phosphorous-containing compounds, potassium, calcium, cadmium, magnesium, manganese, iron and boron, amongst others.

Concerning THOM sequences, performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a THOM polypeptide. Nutrient deficiency may result from a lack of nutrients such as nitrogen, phosphates and other phosphorous-containing compounds, potassium, calcium, cadmium, magnesium, manganese, iron and boron, amongst others.

Performance of the methods of the invention gives plants grown under conditions of salt stress, increased yield relative to control plants grown under comparable conditions. Therefore, according to the present invention, there is provided a method for increasing yield in plants grown under conditions of salt stress, which method comprises modulating expression in a plant of a nucleic acid encoding a THOM polypeptide. The term salt stress is not restricted to common salt (NaCl), but may be any one or more of: NaCl, KCl, LiCl, $MgCl_2$, $CaCl_2$, amongst others.

Concerning BIHD2 sequences, performance of the methods according to the present invention results in plants grown under abiotic stress conditions having increased yield-related traits relative to control plants grown under comparable stress conditions. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. Since diverse environmental stresses activate similar pathways, the exemplification of the present invention with drought stress should not be seen as a limitation to drought stress, but more as a screen to indicate the involvement of BIHD2 polypeptides as defined above, in increasing yield-related traits relative to control plants grown in comparable stress conditions, in abiotic stresses in general.

Performance of the methods of the invention gives plants having increased yield-related traits, under abiotic stress conditions relative to control plants grown in comparable stress conditions. Therefore, according to the present invention, there is provided a method for increasing yield-related traits, in plants grown under abiotic stress conditions, which method comprises increasing expression in a plant of a nucleic acid sequence encoding a BIHD2 polypeptide. According to one aspect of the invention, the abiotic stress is an osmotic stress, selected from one or more of the following: water stress, salt stress, oxidative stress and ionic stress.

Another example of abiotic environmental stress is the reduced availability of one or more nutrients that need to be assimilated by the plants for growth and development. Because of the strong influence of nutrition utilization efficiency on plant yield and product quality, a huge amount of fertilizer is poured onto fields to optimize plant growth and quality. Productivity of plants ordinarily is limited by three primary nutrients, phosphorous, potassium and nitrogen, which is usually the rate-limiting element in plant growth of these three. Therefore the major nutritional element required for plant growth is nitrogen (N). It is a constituent of numerous important compounds found in living cells, including amino acids, proteins (enzymes), nucleic acids, and chlorophyll. 1.5% to 2% of plant dry matter is nitrogen and approximately 16% of total plant protein. Thus, nitrogen availability is a major limiting factor for crop plant growth and production (Frink et al. (1999) Proc Natl Acad Sci USA 96(4): 1175-1180), and has as well a major impact on protein accumulation and amino acid composition. Therefore, of great interest are crop plants with increased yield-related traits, when grown under nitrogen-limiting conditions.

Performance of the methods of the invention gives plants grown under conditions of reduced nutrient availability, particularly under conditions of reduced nitrogen availablity, having increased yield-related traits relative to control plants grown under comparable conditions. Therefore, according to the present invention, there is provided a method for increasing yield-related traits in plants grown under conditions of reduced nutrient availablity, preferably reduced nitrogen availability, which method comprises increasing expression in a plant of a nucleic acid sequence encoding a BIHD2 polypeptide. Reduced nutrient availability may result from a deficiency or excess of nutrients such as nitrogen, phosphates and other phosphorous-containing compounds, potassium, calcium, cadmium, magnesium, manganese, iron and boron, amongst others. Preferably, reduced nutrient availablity is reduced nitrogen availability.

The present invention encompasses plants or parts thereof (including seeds) or cells obtainable by the methods according to the present invention. The plants or parts thereof or cells comprise a nucleic acid transgene encoding an ODC polypeptide, or a BIHD1 polypeptide, a MYB30 polypeptide, or a THOM polypeptide, or a BIHD2 polypeptide as defined above.

The invention also provides genetic constructs and vectors to facilitate introduction and/or (increased) expression in plants of nucleic acids encoding ODC polypeptides, or BIHD1 polypeptides, or MYB30 polypeptides, or THOM polypeptides, or BIHD2 polypeptides as defined herein. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:

(a) a nucleic acid encoding an ODC polypeptide, or a BIHD1 polypeptide, or a MYB30 polypeptide, or a THOM polypeptide, or a BIHD2 polypeptide as defined above;
(b) one or more control sequences capable of driving expression of the nucleic acid sequence of (a); and optionally
(c) a transcription termination sequence.

Preferably, the nucleic acid encoding an ODC polypeptide, or a BIHD1 polypeptide, or a MYB30 polypeptide, or a THOM polypeptide, or a BIHD2 polypeptide is as defined above. The term “control sequence” and “termination sequence” are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Plants are transformed with a vector comprising any of the nucleic acid sequences described above. The skilled artisan is well aware of the genetic elements that must be present on the vector in order to successfully transform, select and propagate host cells containing the sequence of interest. The sequence of interest is operably linked to one or more control sequences (at least to a promoter).

Other organ-specific promoters, for example for preferred expression in leaves, stems, tubers, meristems, seeds (embryo and/or endosperm), are useful in performing the methods of the invention. See the “Definitions” section herein for definitions of the various promoter types.

Advantageously, any type of promoter, whether natural or synthetic, may be used to drive and/or increase expression of the nucleic acid sequence, but preferably the promoter is of plant origin. A constitutive promoter is particularly useful in the methods. Preferably the constitutive promoter is also a ubiquitous promoter. See the “Definitions” section herein for definitions of the various promoter types. Also useful in the methods of the invention is a root-specific promoter.

Concerning BIHD1 sequences, preferably, one of the control sequences of a construct is a seed-specific promoter. An example of a seed-specific promoter is a WSI18 promoter, preferably a rice WSI18 promoter, more preferably a WSI18 promoter as represented by SEQ ID NO: 84. Another example of a seed-specific promoter is a RAB21 promoter, preferably a rice RAB21 promoter, more preferably a RAB21 promoter as represented by SEQ ID NO: 85. Further examples of seed-specific promoters can be found in the “Definitions” section hereinabove.

Advantageously, any type of promoter, whether natural or synthetic, may be used to drive expression of the nucleic acid sequence. See the “Definitions” section herein for definitions of the various promoter types. A young green tissue-specific promoter is particularly useful in the methods. Preferably, the nucleic acid sequence encoding a MYB30 polypetide is operably linked to a young green tissue-specific promoter as defined herein. The young green tissue-specific promoter is preferably a protochlorophyllide reductase (PcR) promoter, more preferably the protochlorophyllide reductase promoter represented by a nucleic acid sequence substantially similar to SEQ ID NO: 118, most preferably the promoter is as represented by SEQ ID NO: 118.

Concerning ODC sequences, it should be clear that the applicability of the present invention is not restricted to the ODC polypeptide-encoding nucleic acid represented by SEQ ID NO: 1, nor is the applicability of the invention restricted to expression of an ODC polypeptide-encoding nucleic acid when driven by a constitutive promoter.

The constitutive promoter is preferably a GOS2 promoter, preferably a GOS2 promoter from rice. Further preferably the constitutive promoter is represented by a nucleic acid sequence substantially similar to SEQ ID NO: 61, most preferably the constitutive promoter is as represented by SEQ ID NO: 61. See Table 2a in the "Definitions" section herein for further examples of constitutive promoters.

Concerning BIHD1 sequences, it should be clear that the applicability of the present invention is not restricted to a nucleic acid sequence encoding the BIHD1 polypeptide, as represented by SEQ ID NO: 66, nor is the applicability of the invention restricted to expression of a BIHD1 polypeptide-encoding nucleic acid sequence when driven by a seed-specific promoter.

Concerning MYB30 sequences, it should be clear that the applicability of the present invention is not restricted to the MYB30 polypeptide-encoding nucleic acid represented by SEQ ID NO: 88, nor is the applicability of the invention restricted to expression of a MYB30 polypeptide-encoding nucleic acid when driven by a green tissue-specific promoter.

Concerning THOM sequences, it should be clear that the applicability of the present invention is not restricted to the THOM polypeptide-encoding nucleic acid represented by SEQ ID NO: 122, nor is the applicability of the invention restricted to expression of a THOM polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 131, most preferably the constitutive promoter is as represented by SEQ ID NO: 131. See the "Definitions" section herein for further examples of constitutive promoters.

Concerning BIHD2 sequences, it should be clear that the applicability of the present invention is not restricted to the BIHD2 polypeptide-encoding nucleic acid represented by SEQ ID NO: 192, nor is the applicability of the invention restricted to expression of a BIHD2 polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 248, most preferably the constitutive promoter is as represented by SEQ ID NO: 248. See the "Definitions" section herein for further examples of constitutive promoters.

Plants are transformed with a vector comprising any of the nucleic acid sequences described above. The skilled artisan is well aware of the genetic elements that must be present on the vector in order to successfully transform, select and propagate host cells containing the sequence of interest. The sequence of interest is operably linked to one or more control sequences (at least to a promoter).

Concerning BIHD2 sequences, it should also be clear that the applicability of the present invention is not restricted to a nucleic acid sequence encoding the BIHD2 polypeptide, as represented by SEQ ID NO: 192, nor is the applicability of the invention restricted to expression of a BIHD2 polypeptide-encoding nucleic acid sequence when driven by a seed-specific promoter.

Optionally, one or more terminator sequences may be used in the construct introduced into a plant. Additional regulatory elements may include transcriptional as well as translational increasers. Those skilled in the art will be aware of terminator and enhancer (or increaser) sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, increaser, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acid sequences, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the "definitions" section.

It is known that upon stable or transient integration of nucleic acid sequences into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid sequence molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid sequence can be identified for example by selection (for example, cells which have integrated the selectable marker survive whereas the other cells die). The marker genes may be removed or excised from the transgenic cell once they are no longer needed. Techniques for marker gene removal are known in the art, useful techniques are described above in the definitions section.

The invention also provides a method for the production of transgenic plants having enhanced yield-related traits relative to control plants, comprising introduction and expression in a plant of any nucleic acid sequence encoding an ODC polypeptide, or a BIHD1 polypeptide, or a MYB30 polypeptide, or a THOM polypeptide, or a BIHD2 polypeptide as defined hereinabove.

More specifically, the present invention provides a method for the production of transgenic plants having enhanced and/or increased yield-related traits, particularly increased (seed) yield, which method comprises:

(i) introducing and expressing in a plant, or plant part, or plant cell a nucleic acid encoding an ODC polypeptide, or a BIHD1 polypeptide, or a MYB30 polypeptide, or a THOM polypeptide, or a BIHD2 polypeptide; and (ii) cultivating the plant cell under conditions promoting plant growth and development.

The nucleic acid sequence of (i) may be any of the nucleic acid sequences capable of encoding an ODC polypeptide, or a BIHD1 polypeptide, or a MYB30 polypeptide, or a THOM polypeptide, or a BIHD2 polypeptide as defined herein.

The nucleic acid sequence may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höofgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid sequence encoding an ODC polypeptide, or a BIHD1 polypeptide, or a MYB30 polypeptide, or a THOM polypeptide, or a BIHD2 polypeptide as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, linseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, *triticale, sorghum*, emmer, spelt, *secale*, einkorn, teff, milo and oats.

The invention also extends to harvestable parts of a plant comprising an isolated nucleic acid sequence encoding an ODC polypeptide, or a BIHD1 polypeptide, or a THOM polypeptide, or a BIHD2 polypeptide (as defined hereinabove). Such harvestable parts include, but are not limited to seeds, leaves, fruits, flowers, stems, roots, rhizomes, tubers and bulbs. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid sequence encoding an ODC polypeptide, or a BIHD1 polypeptide, or a MYB30 polypeptide, or a THOM polypeptide, or a BIHD2 polypeptide is by introducing and expressing in a plant a nucleic acid sequence encoding an ODC polypeptide or a BIHD1 polypeptide, or a MYB30 polypeptide, or a THOM polypeptide, or a BIHD2 polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

The present invention also encompasses use of nucleic acids sequences encoding ODC polypeptides, or MYB30 polypeptides, or THOM polypeptides as described herein and use of these ODC polypeptides, or MYB30 polypeptides, or THOM polypeptides in enhancing any of the aforementioned yield-related traits in plants.

Furthermore, the present invention also encompasses use of nucleic acid sequences encoding BIHD1 polypeptides, or BIHD2 polypeptides as described herein and use of these BIHD1 polypeptides, or BIHD2 polypeptides in increasing any of the aforementioned yield-related traits in plants, under normal growth conditions, under abiotic stress growth (preferably osmotic stress growth conditions) conditions, and under growth conditions of reduced nutrient availability, preferably under conditions of reduced nitrogen availability.

Concerning ODC sequences, nucleic acids sequences encoding ODC polypeptide described herein, or the ODC polypeptides themselves, may find use in breeding programmes in which a DNA marker is identified which may be genetically linked to an ODC polypeptide-encoding gene. The nucleic acids/genes, or the ODC polypeptides themselves may be used to define a molecular marker. This DNA or protein marker may then be used in breeding programmes to select plants having enhanced yield-related traits as defined hereinabove in the methods of the invention.

Concerning BIHD1 sequences, nucleic acid sequences encoding BIHD1 polypeptides described herein, or the BIHD1 polypeptides themselves, may find use in breeding programmes in which a DNA marker is identified that may be genetically linked to a BIHD1 polypeptide-encoding gene. The genes/nucleic acid sequences, or the BIHD1 polypeptides themselves may be used to define a molecular marker. This DNA or protein marker may then be used in breeding programmes to select plants having increased yield-related traits, as defined hereinabove in the methods of the invention.

Concerning MYB30 sequences, nucleic acids sequences encoding MYB30 polypeptides described herein, or the MYB30 polypeptides themselves, may find use in breeding programmes in which a DNA marker is identified which may be genetically linked to a MYB30 polypeptide-encoding gene. The nucleic acids/genes, or the MYB30 polypeptides themselves may be used to define a molecular marker. This DNA or protein marker may then be used in breeding programmes to select plants having enhanced yield-related traits as defined hereinabove in the methods of the invention.

Concerning THOM sequences, nucleic acids encoding THOM polypeptide described herein, or the THOM polypeptides themselves, may find use in breeding programmes in which a DNA marker is identified which may be genetically linked to a THOM polypeptide-encoding gene. The nucleic acids/genes, or the THOM polypeptides themselves may be used to define a molecular marker. This DNA or protein marker may then be used in breeding programmes to select plants having enhanced yield-related traits as defined hereinabove in the methods of the invention.

Concerning BIHD2 sequence, nucleic acid sequences encoding BIHD2 polypeptides described herein, or the BIHD2 polypeptides themselves, may find use in breeding programmes in which a DNA marker is identified that may be genetically linked to a BIHD2 polypeptide-encoding gene. The genes/nucleic acid sequences, or the BIHD2 polypeptides themselves may be used to define a molecular marker. This DNA or protein marker may then be used in breeding programmes to select plants having increased yield-related traits, as defined hereinabove in the methods of the invention.

Allelic variants of a gene/nucleic acid sequence encoding an ODC polypeptide, or a BIHD1 polypeptide, or a MYB30 polypeptide, or a THOM polypeptide, or a BIHD2 polypeptide may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids sequences encoding ODC polypeptides, or BIHD1 polypeptides, or MYB30 polypeptides, or THOM polypeptides, or BIHD2 polypeptides may also be used as probes for genetically and physically mapping the genes that they are a part of, and as markers for traits linked to those genes. Such information may be useful in plant breeding in order to develop lines with desired phenotypes. Such use of nucleic acid sequences encoding an ODC polypeptide, or a BIHD polypeptide, or a MYB30 polypeptide, or a THOM polypeptide, or a BIHD2 polypeptide requires only a nucleic acid sequence of at least 15 nucleotides in length. The nucleic acid sequences encoding an ODC polypeptide, or a BIHD1 polypeptide, or a MYB30 polypeptide, or a THOM polypeptide, or a BIHD2 polypeptide may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acid sequences encoding an ODC polypeptide, or a BIHD1 polypeptide, or a MYB30 polypeptide, or a THOM polypeptide, or a BIHD2 polypeptide. The resulting banding patterns may then be subjected to genetic analyses using computer programs such as MapMaker (Lander et al. (1987) Genomics 1: 174-181) in order to construct a genetic map. In addition, the nucleic acid sequences may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid sequence encoding an ODC polypeptide, a BIHD1 polypeptide, or a MYB30 polypeptide, or a BIHD2 polypeptide in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid sequence probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid sequence amplification-based methods for genetic and physical mapping may be carried out using the nucleic acid sequences. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions.

The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanded and/or increased yield-related traits, as described hereinbefore. These traits may also be combined with other economically advantageous traits, such as further yield-enhancing and/or yield-increasing traits, tolerance to abiotic and biotic stresses, tolerance to herbicides, insectides, traits modifying various architectural features and/or biochemical and/or physiological features.

Items

1. A method for enhancing yield-related traits in plants relative to control plants, comprising modulating expression in a plant of a nucleic acid encoding an Ornithine Decarboxylase polypeptide and optionally selecting for plants having enhanced yield-related traits.
2. Method according to item 1, wherein said Ornithine decarboxylase polypeptide, when used in the construction of a phylogenetic tree of alpha/beta-barrel fold basic amino acid decarboxylase polypeptides, clusters with the clades comprising Ornithine Decarboxylase rather than Arginine Decarboxylase, Diaminopimelate Decarboxylase, or Carboxynorspermidine Decarboxylase polypeptides.
3. Method according to item 1 or 2, wherein said Ornithine Decarboxylase polypeptide comprises one or more of the following sequences:
   (i) 30%, 35%, 40%, 45%, 50%, 55%, 60%, 65%, 70%, 75%, 80%, 85%, 90%, 95%, 96%, 97%, 98%, 99% or more sequence identity to the amino acid sequence of any of the polypeptides of Table A1
   (ii) 50%, 55%, 60%, 65%, 70%, 75%, 80%, 85%, 90%, 95%, 96%, 97%, 98%, 99% or more sequence identity to the amino acid sequence of any of the domains as set forth in Table C1 of Example 4.
   (iii) 50%, 55%, 60%, 65%, 70%, 75%, 80%, 85%, 90%, 95%, 96%, 97%, 98%, 99% or more sequence identity to the amino acid sequence of Motif 1: [N/G]AR[C/V]P[L/M][G/S][P/L]K[Y/F]GALPE E[V/A]EPLL[R/Q][A/T]A[Q/K][A/E][A/L ][G/R]LTV[S/V]GVSFH[V/I]GSG (SEQ ID NO: 51);
   (iv) 50%, 55%, 60%, 65%, 70%, 75%, 80%, 85%, 90%, 95%, 96%, 97%, 98%, 99% or more sequence identity to the amino acid sequence of Motif 2: [K/D][D/Q][P/A]FYV[L/V]DL[G/A][E/V]VV[S/R]LMDQW[R/K/N][A/S] (SEQ ID NO: 52);
   (v) 50%, 55%, 60%, 65%, 70%, 75%, 80%, 85%, 90%, 95%, 96%, 97%, 98%, 99% or more sequence identity to the amino acid sequence of Motif 3: RI[V/I][F/Y]ANPCK[P/R]ES[D/H]I[I/K/R][Y/F]AA[K/S]VGVNLTT[Y/F]DSEDE[V/L][Y/E]K[I/V][R/A/K]KHHP (SEQ ID NO: 53);
   (vi) 50%, 55%, 60%, 65%, 70%, 75%, 80%, 85%, 90%, 95%, 96%, 97%, 98%, 99% or more sequence identity to the amino acid sequence of Motif 4: EY[W/Y]I[N/D]DG[L/V/I]YGS[F/M/L]NC[I/V]L[Y/F]DHAT (SEQ ID NO: 54);
   (vii) 50%, 55%, 60%, 65%, 70%, 75%, 80%, 85%, 90%, 95%, 96%, 97%, 98%, 99% or more sequence identity to the amino acid sequence of Motif 5: EYVLSLG[V/I]SPD (SEQ ID NO: 55);
   (viii) 50%, 55%, 60%, 65%, 70%, 75%, 80%, 85%, 90%, 95%, 96%, 97%, 98%, 99% or more sequence identity to the amino acid sequence of Motif 6: AI[A/E]AA[K/R]EVF[E/D][T/A]A[A/S][K/Q/R][L/F]G[M/UP/S][K/R/P]M[T/R]VL[D/N][I/V]GGGFT[S/A]G[H/P]QF[T/E][T/E]AA[AN][A/K/V][V/I][K/N][S/A] (SEQ ID NO: 56);
   (ix) 50%, 55%, 60%, 65%, 70%, 75%, 80%, 85%, 90%, 95%, 96%, 97%, 98%, 99% or more sequence identity to the amino acid sequence of Motif 7: [G/I]G[G/A]AP[P/T/V]AAAA[A/E][EN][N/D/G][G/H]TRKV[V/I]PLS[R/K]DALQDFM[V/L]SIITQKLQD[E/D] (SEQ ID NO: 57);
   (x) 50%, 55%, 60%, 65%, 70%, 75%, 80%, 85%, 90%, 95%, 96%, 97%, 98%, 99% or more sequence identity to the amino acid sequence of Motif 8: QT[V/I]IVSGLNPAAILQ (SEQ ID NO: 58).
4. Method according to item 1, 2 or 3, wherein said modulated expression is effected by introducing and expressing in a plant a nucleic acid encoding an Ornithine Decarboxylase polypeptide.
5. Method according to any preceding item, wherein said nucleic acid encoding an Ornithine Decarboxylase polypeptide encodes any one of the proteins listed in Table A1 or is a portion of such a nucleic acid, or a nucleic acid capable of hybridising with such a nucleic acid or the complement thereof.
6. Method according to any preceding item, wherein said nucleic acid sequence encodes an orthologue or paralogue of any of the proteins given in Table A1.
7. Method according to any preceding item, wherein said enhanced yield-related traits comprise increased shoot biomass and/or seed yield relative to control plants.
8. Method according to any preceding item wherein said enhanced yield-related traits are obtained under cultivation conditions of nitrogen deficiency.
9. Method according to any one of items 4 to 8, wherein said nucleic acid is operably linked to a constitutive promoter, preferably to a GOS2 promoter, most preferably to a GOS2 promoter from rice.
10. Method according to any preceding item, wherein said nucleic acid encoding an Ornithine Decarboxylase polypeptide is of plant origin, preferably from a dicotyledonous plant, further preferably from the family Solanaceae, most preferably from *Nicotiana tabacum.*
11. Plant or part thereof, including seeds, obtainable by a method according to any preceeding item, wherein said plant or part thereof comprises a recombinant nucleic acid encoding an Ornithine Decarboxylase polypeptide.
12. Construct comprising:
   (i) nucleic acid encoding an Ornithine Decarboxylase polypeptide as defined in items 1, 2 or 3;
   (ii) one or more control sequences capable of driving expression of the nucleic acid sequence of (a); and optionally
   (iii) a transcription termination sequence.

13. Construct according to item 12, wherein one of said control sequences is a constitutive promoter, preferably a GOS2 promoter, most preferably a GOS2 promoter from rice.
14. Use of a construct according to item 12 or 13 in a method for making plants having increased yield, particularly increased seed yield relative to control plants.
15. Plant, plant part or plant cell transformed with a construct according to item 12 or 13.
16. Method for the production of a transgenic plant having increased yield, preferably increased seed yield relative to control plants, comprising:
   (i) introducing and expressing in a plant a nucleic acid encoding an Ornithine Decarboxylase polypeptide as defined in item 1, 2 or 3; and
   (ii) cultivating the plant cell under conditions promoting plant growth and development; and optionally
   (iii) selecting for plants having enhanced yield-related traits
17. Transgenic plant having increased yield, particularly increased biomass, relative to control plants, resulting from modulated expression of a nucleic acid encoding an Ornithine Decarboxylase polypeptide as defined in item 1, 2 or 3 or a transgenic plant cell derived from said transgenic plant.
18. Transgenic plant according to item 11, 15 or 17, or a transgenic plant cell derived therefrom, wherein said plant is a crop plant or a monocot or a cereal, such as rice, maize, wheat, barley, millet, rye, *triticale, sorghum* and oats.
19. Harvestable parts of a plant according to item 18, wherein said harvestable parts are preferably shoot biomass and/or seeds.
20. Products derived from a plant according to item 18 and/or from harvestable parts of a plant according to item 19.
21. Use of a nucleic acid encoding an Ornithine Decarboxylase polypeptide in increasing yield, particularly in increasing shoot and/or biomass in plants, relative to control plants.
22. A method for increasing yield-related traits in plants relative to control plants, comprising increasing expression in a plant of a nucleic acid sequence encoding a benzothiadiazole-induced homeodomain 1 (BIHD1) polypeptide, which BIHD1 polypeptide has in increasing order of preference at least 50%, 55%, 60%, 65%, 70%, 75%, 80%, 85%, 90%, 95%, 98%, 99% or more amino acid sequence identity to a BIHD1 polypeptide as represented by SEQ ID NO: 67, and optionally selecting for plants having increased yield-related traits.
23. Method according to item 22, wherein said BIHD1 polypeptide comprises: (i) a homeobox domain with an InterPro accession IPRO001356; (ii) a POX domain with an InterPro accession IPRO06563; and (ii) at least one predicted coiled coil domain.
24. Method according to item 22 or 23, wherein said BIHD1 polypeptide, when used in the construction of a BIHD1 phylogenetic tree, such as the one depicted in FIG. 4, clusters with the clade of BELL-1 homeodomain polypeptides rather than with any other homeodomain poypeptide clade.
25. Method according to any one of the items 22 to 24, wherein said BIHD1 polypeptide has in increasing order of preference at least 50%, 55%, 60%, 65%, 70%, 75%, 80%, 85%, 90%, 95%, 98%, 99% or more amino acid sequence identity to any of the polypeptide sequences given in Table A2 herein.
26. Method according to any one of the items 22 to 25, wherein said nucleic acid sequence encoding a BIHD1 polypeptide is represented by any one of the nucleic acid sequence SEQ ID NOs given in Table A2 or a portion thereof, or a sequence capable of hybridising with any one of the nucleic acid sequences SEQ ID NOs given in Table A2.
27. Method according to any one of the items 22 to 26, wherein said nucleic acid sequence encodes an orthologue or paralogue of any of the polypeptide sequence SEQ ID NOs given in Table A2.
28. Method according to any one of the items 22 to 27, wherein said increased expression is effected by any one or more of: T-DNA activation tagging, TILLING, or homologous recombination.
29. Method according to any one of the items 22 to 28, wherein said increased expression is effected by introducing and expressing in a plant a nucleic acid sequence encoding a BIHD1 polypeptide.
30. Method according to any one of the items 22 to 29, wherein said increased yield-related trait is one or more of: increased early vigour, increased total seed yield per plant, increased number of filled seeds, increased total number of seeds, or increased harvest index.
31. Method according to any one of the items 22 to 30, wherein said nucleic acid sequence is operably linked to a seed-specific promoter.
32. Method according to item 31, wherein said seed-specific promoter is preferably a WSI18 promoter, more preferably to a WSI18 promoter from rice, most preferably a WSI19 promoter as represented by SEQ ID NO: 84.
33. Method according to item 31, wherein said seed-specific promoter is preferably a RAB21 promoter, more preferably to a RAB21 promoter from rice, most preferably a RAB21 promoter as represented by SEQ ID NO: 85.
34. Method according to any one of the items 22 to 33, wherein said nucleic acid sequence encoding a BIHD1 polypeptide is of plant origin, preferably from a monocotyledonous plant, further preferably from the family Poacae, more preferably from the genus *Oryza*, most preferably from *Oryza sativa.*
35. Plants, parts thereof (including seeds), or plant cells obtainable by a method according to any preceding item, wherein said plant, part or cell thereof comprises an isolated nucleic acid transgene encoding a BIHD1 polypeptide operably linked to a seed-specific promoter.
36. Construct comprising:
   (a) A nucleic acid sequence encoding a BIHD1 polypeptide as defined in any one of item 22 to 27;
   (b) one or more control sequences capable of driving expression of the nucleic acid sequence of (a); and optionally
   (c) a transcription termination sequence.
37. Construct according to item 36, wherein said control sequence is seed-specific promoter.
38. Use of a construct according to item 36 or 37 in a method for making plants having increased yield-related traits relative to control plants, which increased yield-related traits are one or more of: increased early vigour, increased total seed yield per plant, increased number of filled seeds, increased total number of seeds, or increased harvest index.
39. Plant, plant part or plant cell transformed with a construct according to item 36 or 37.
40. Method for the production of transgenic plants having increased yield-related traits relative to control plants, comprising:

(i) introducing and expressing in a plant, plant part, or plant cell, a nucleic acid sequence encoding a BIHD1 polypeptide as defined in any one of item 22 to 27; and (ii) cultivating the plant cell, plant part, or plant under conditions promoting plant growth and development.

41. Transgenic plant having increased yield-related traits relative to control plants, resulting from increased expression of a nucleic acid sequence encoding a BIHD1 polypeptide as defined in any one of item 22 to 27, operably linked to a seed-specific promoter, or a transgenic plant cell or transgenic plant part derived from said transgenic plant.

42. Transgenic plant according to item 35, 39 or 41, wherein said plant is a crop plant or a monocot or a cereal, such as rice, maize, wheat, barley, millet, rye, *triticale, sorghum*and oats, or a transgenic plant cell derived from said transgenic plant.

43. Harvestable parts comprising an isolated nucleic acid sequence encoding a BIHD1 polypeptide, of a plant according to item 42, wherein said harvestable parts are preferably seeds.

44. Products comprising an isolated nucleic acid sequence encoding a BIHD1 polypeptide derived, from a plant according to item 42 and/or from harvestable parts of a plant according to item 43.

45. Use of a nucleic acid sequence encoding a BIHD1 polypeptide as defined in any one of item 22 to 27 in increasing yield-related traits, comprising one or more of: increased early vigour, increased total seed yield per plant, increased number of filled seeds, increased total number of seeds, or increased harvest index.

46. A method for enhancing yield-related traits in plants relative to control plants, comprising modulating expression in a plant of a nucleic acid encoding a MYB30 polypeptide, wherein said MYB30 polypeptide comprises at least one SANT domain.

47. Method according to item 46, wherein said MYB30 polypeptide comprises one or more of the motifs 9 to 11 (SEQ ID NO: 119 to SEQ ID NO: 121).

48. Method according to item 46 or 47, wherein said modulated expression is effected by introducing and expressing in a plant a nucleic acid encoding a MYB30 polypeptide.

49. Method according to any one of items 46 to 48, wherein said nucleic acid encoding a MYB30 polypeptide encodes any one of the proteins listed in Table A3 or is a portion of such a nucleic acid, or a nucleic acid capable of hybridising with such a nucleic acid.

50. Method according to any one of items 46 to 49, wherein said nucleic acid sequence encodes an orthologue or paralogue of any of the proteins given in Table A3.

51. Method according to any one of items 46 to 50, wherein said enhanced yield-related traits comprise increased increased biomass and/or increased emergence vigour relative to control plants.

52. Method according to any one of items 46 to 51, wherein said enhanced yield-related traits are obtained under non-stress conditions.

53. Method according to any one of items 48 to 52, wherein said nucleic acid is operably linked to a green tissue-specific promoter, preferably to a pPcR promoter, most preferably to a pPcR promoter from rice.

54. Method according to any one of items 46 to 53, wherein said nucleic acid encoding a MYB30 polypeptide is of plant origin, preferably from a dicotyledonous plant, further preferably from the family Brassicaceae, more preferably from the genus *Arabidopsis*, most preferably from *Arabidopsis thaliana.*

55. Plant or part thereof, including seeds, obtainable by a method according to any preceding item, wherein said plant or part thereof comprises a recombinant nucleic acid encoding a MYB30 polypeptide.

56. Construct comprising:

(i) nucleic acid encoding a class MYB30 polypeptide as defined in items 46 or 47;

(ii) one or more control sequences capable of driving expression of the nucleic acid sequence of (a); and optionally (iii) a transcription termination sequence.

57. Construct according to item 56, wherein one of said control sequences is a green tissue-specific promoter, preferably a pPcR promoter, most preferably a pPcR promoter from rice.

58. Use of a construct according to item 56 or 57 in a method for making plants having increased yield, particularly increased biomass and/or increased emergence vigour relative to control plants.

59. Plant, plant part or plant cell transformed with a construct according to item 56 or 57.

60. Method for the production of a transgenic plant having increased yield, particularly increased biomass and/or increased emergence vigour relative to control plants, comprising:

(i) introducing and expressing in a plant a nucleic acid encoding a MYB7 polypeptide as defined in item 46 or 47; and (ii) cultivating the plant cell under conditions promoting plant growth and development.

61. Transgenic plant having increased yield, particularly increased biomass and/or increased emergence vigour, relative to control plants, resulting from modulated expression of a nucleic acid encoding a MYB30 polypeptide as defined in item 46 or 47, or a transgenic plant cell derived from said transgenic plant.

62. Transgenic plant according to item 55, 59 or 61, or a transgenic plant cell derived thereof, wherein said plant is a crop plant or a monocot or a cereal, such as rice, maize, wheat, barley, millet, rye, *triticale, sorghum* and oats.

63. Harvestable parts of a plant according to item 62, wherein said harvestable parts are preferably vegetative biomass.

64. Products derived from a plant according to item 62 and/or from harvestable parts of a plant according to item 63.

65. Use of a nucleic acid encoding a MYB30 polypeptide in enhancing yield-related traits, particularly in increasing biomass and/or emergence vigour in plants, relative to control plants.

66. A method for enhancing yield-related traits in plants relative to control plants, comprising modulating expression in a plant of a nucleic acid encoding a THOM polypeptide, wherein said THOM polypeptide comprises (i) an "N-terminal HD-ZIP" Leucine zipper domain (ii) a homeobox domain, (iii) a HALZ leucine zipper domain associated with the homeobox domain.

67. Method according to item 66, wherein said THOM polypeptide comprises one or more of the following motifs:

(i) Motif 12, SEQ ID NO: 124, (ii) Motif 13, SEQ ID NO: 125, (iii) Motif 14, SEQ ID NO: 126.

68. Method according to item 66 or 67, wherein said modulated expression is effected by introducing and expressing in a plant a nucleic acid encoding a THOM polypeptide.

69. Method according to any one of items 66 to 68, wherein said nucleic acid encoding a THOM polypeptide encodes any one of the proteins listed in Table A4 or is a portion of such a nucleic acid, or a nucleic acid capable of hybridising with such a nucleic acid.

70. Method according to any one of items 66 to 69, wherein said nucleic acid sequence encodes an orthologue or paralogue of any of the proteins given in Table A4.
71. Method according to any one of items 66 to 70, wherein said enhanced yield-related traits comprise increased yield, preferably increased seed yield relative to control plants.
72. Method according to any one of items 68 to 71, wherein said nucleic acid is operably linked to a constitutive promoter, preferably to a GOS2 promoter, most preferably to a GOS2 promoter from rice.
73. Method according to any one of items 66 to 72, wherein said nucleic acid encoding a THOM polypeptide is of plant origin, preferably from a dicotyledonous plant, further preferably from the family Solanaceae, more preferably from the genus *Solanum*, most preferably from *Solanum lycopersicum.*
74. Plant or part thereof, including seeds, obtainable by a method according to any one of items 66 to 73, wherein said plant or part thereof comprises a recombinant nucleic acid encoding a THOM polypeptide.
75. Construct comprising:
    (i) nucleic acid encoding a THOM polypeptide as defined in items 65 or 66;
    (ii) one or more control sequences capable of driving expression of the nucleic acid sequence of (a); and optionally
    (iii) a transcription termination sequence.
76. Construct according to item 75, wherein one of said control sequences is a constitutive promoter, preferably a GOS2 promoter, most preferably a GOS2 promoter from rice.
77. Use of a construct according to item 75 or 76 in a method for making plants having increased yield, particularly increased biomass and/or increased seed yield relative to control plants.
78. Plant, plant part or plant cell transformed with a construct according to item 75 or 76.
79. Method for the production of a transgenic plant having increased yield, particularly increased increased seed yield relative to control plants, comprising:
    (i) introducing and expressing in a plant a nucleic acid encoding a THOM polypeptide as defined in item 66 or 67; and
    (ii) cultivating the plant cell under conditions promoting plant growth and development.
80. Transgenic plant having increased yield, particularly increased seed yield, relative to control plants, resulting from modulated expression of a nucleic acid encoding a THOM polypeptide as defined in item 66 or 67, or a transgenic plant cell derived from said transgenic plant.
81. Transgenic plant according to item 74, 78 or 80, or a transgenic plant cell derived thereof, wherein said plant is a crop plant or a monocot or a cereal, such as rice, maize, wheat, barley, millet, rye, *triticale, sorghum emmer*, spelt, *secale*, einkorn, teff, milo and oats.
82. Harvestable parts of a plant according to item 81, wherein said harvestable parts are preferably shoot biomass and/or seeds.
83. Products derived from a plant according to item 81 and/or from harvestable parts of a plant according to item 82.
84. Use of a nucleic acid encoding a THOM polypeptide in increasing yield, particularly in increasing seed yield and/or shoot biomass in plants, relative to control plants.
85. A method for increasing yield-related traits in plants relative to control plants, comprising increasing expression in a plant of a nucleic acid sequence encoding a benzothiadiazole-induced homeodomain 2 (BIHD2) polypeptide, which BIHD2 polypeptide has in increasing order of preference at least 50%, 55%, 60%, 65%, 70%, 75%, 80%, 85%, 90%, 95%, 98%, 99% or more amino acid sequence identity to a BIHD2 polypeptide as represented by SEQ ID NO: 193, and optionally selecting for plants having increased yield-related traits.
86. Method according to item 85, wherein said BIHD2 polypeptide comprises: (i) a homeobox domain with an InterPro accession IPRO001356; (ii) a POX domain with an InterPro accession IPRO06563; and (ii) at least one predicted coiled coil domain.
87. Method according to item 85 or 86, wherein said BIHD2 polypeptide, is a polypeptide comprising a domain having at least 50 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to any of the domains i) a homeobox domain with an InterPro accession IPRO001356; (ii) a POX domain with an InterPro accession IPRO06563 as present in any of the polypeptides of Table A5, preferably as present in SEQ ID NO:193.
88. Method according to any one of items 85 to 87, wherein said BIHD2 polypeptide has in increasing order of preference at least 50%, 55%, 60%, 65%, 70%, 75%, 80%, 85%, 90%, 95%, 98%, 99% or more amino acid sequence identity to any of the polypeptide sequences given in Table A5 herein.
89. Method according to any one of items 85 to 88, wherein said nucleic acid sequence encoding a BIHD2 polypeptide is represented by any one of the nucleic acid sequence SEQ ID NOs given in Table A5 or a portion thereof, or a sequence capable of hybridising with any one of the nucleic acid sequences SEQ ID NOs given in Table A5.
90. Method according to any one of items 85 to 89, wherein said nucleic acid sequence encodes an orthologue or paralogue of any of the polypeptide sequence SEQ ID NOs given in Table A5.
91. Method according to any one of items 85 to 90, wherein said increased expression is effected by any one or more of: T-DNA activation tagging, TILLING, or homologous recombination.
92. Method according to any one of items 85 to 91, wherein said increased expression is effected by introducing and expressing in a plant a nucleic acid sequence encoding a BIHD2 polypeptide.
93. Method according to any one of items 85 to 92, wherein said increased yield-related trait is one or more of: increased early vigour, increased total seed yield per plant, increased number of filled seeds, increased total number of seeds, or increased harvest index.
94. Method according to any one of items 85 to 93, wherein said nucleic acid sequence is operably linked to a constitutive promoter.
95. Method according to item 94, wherein said constitutive promoter is preferably a medium strength promoter, more preferably selected from a plant derived promoter, most preferably from rice.
96. Method according to item 94, wherein said constitutive promoter is preferably a GOS2 promoter, more preferably a GOS2 promoter from rice, most preferably a GOS2 promoter as represented by SEQ ID NO: 248.

97. Method according to any one of items 85 to 96, wherein said nucleic acid sequence encoding a BIHD2 polypeptide is of plant origin, preferably from a dicotyledonous plant, further preferably from a leguminous plant, more preferably from the genus *medicago*, most preferably from *medicago truncatula*.
98. Plants, parts thereof (including seeds), or plant cells obtainable by a method according to any preceding item, wherein said plant, part or cell thereof comprises an isolated nucleic acid transgene encoding a BIHD2 polypeptide operably linked to a constitutive promoter.
99. Construct comprising:
   (i) A nucleic acid sequence encoding a BIHD2 polypeptide as defined in any one of items 85 to 90;
   (ii) one or more control sequences capable of driving expression of the nucleic acid sequence of (a); and optionally
   (iii) a transcription termination sequence.
100. Construct according to item 99, wherein said control sequence is constitutive promoter.
101. Use of a construct according to items 99 or 100 in a method for making plants having increased yield-related traits relative to control plants, which increased yield-related traits are one or more of: increased early vigour, increased total seed yield per plant, increased number of filled seeds, increased total number of seeds, or increased harvest index.
102. Plant, plant part or plant cell transformed with a construct according to item 98 or 99.
103. Method for the production of transgenic plants having increased yield-related traits relative to control plants, comprising:
   (i) introducing and expressing in a plant, plant part, or plant cell, a nucleic acid sequence encoding a BIHD2 polypeptide as defined in any one of items 85 to 90; and
   (ii) cultivating the plant cell, plant part, or plant under conditions promoting plant growth and development.
104. Transgenic plant having increased yield-related traits relative to control plants, resulting from increased expression of a nucleic acid sequence encoding a BIHD2 polypeptide as defined in any one of items 85 to 90, operably linked to a constitutive promoter, or a transgenic plant cell or transgenic plant part derived from said transgenic plant.
105. Transgenic plant according to item 98, 102 or 104, wherein said plant is a crop plant or a monocot or a cereal, such as rice, maize, wheat, barley, millet, rye, *triticale*, sorghum and oats, or a transgenic plant cell derived from said transgenic plant.
106. Harvestable parts comprising an isolated nucleic acid sequence encoding a BIHD2 polypeptide, of a plant according to item 105, wherein said harvestable parts are preferably seeds.
107. Products comprising an isolated nucleic acid sequence encoding a BIHD2 polypeptide derived, from a plant according to item 105 and/or from harvestable parts of a plant according to item 106.
108. Use of a nucleic acid sequence encoding a BIHD2 polypeptide as defined in any one of items 84 to 89 in increasing yield-related traits, comprising one or more of: increased early vigour, increased total seed yield per plant, increased number of filled seeds, increased total number of seeds, or increased harvest index.

DESCRIPTION OF FIGURES

The present invention will now be described with reference to the following figures in which:

FIG. 2 B Shows a phylogenetic tree of beta/alpha barrel decarboxylases polypeptides.

FIG. 8 represents the domain structure, seq of SEQ ID NO: 89.

FIG. 9 represents a multiple alignment of MYB30 polypeptides.

FIG. 10 represents the binary vector for increased expression in *Oryza sativa* of a MYB30-encoding nucleic acid under the control of a rice protochlorophyllide reductase promoter (pPcR).

FIG. 11 represents the domain structure of SEQ ID NO: 123 with conserved motifs or domains: in bold: HD-ZIP domain, underlined: Homeobox (HOX) domain, in italics: homeobox associated leucin zipper (HALZ).

FIG. 12 represents a multiple alignment of THOM polypeptides. SEQ ID NO: 123 is represented by Le_THOM.

FIG. 14 shows an AlignX (from Vector NTI 10.3, Invitrogen Corporation) multiple sequence alignment of the BIHD2 polypeptides from Table A5. The PFAM homeobox domain PF00046 (intergrated into InterPro accession number IPRO001356) and the PFAM POX domain PF07526 (intergrated into InterPro accession number IPRO006563) are identified. The PYP and WF conserved amino acids, which are believed to interact directly with the DNA target sequence, are identified by their single amino acid code (underlined).

EXAMPLES

Figure 1:
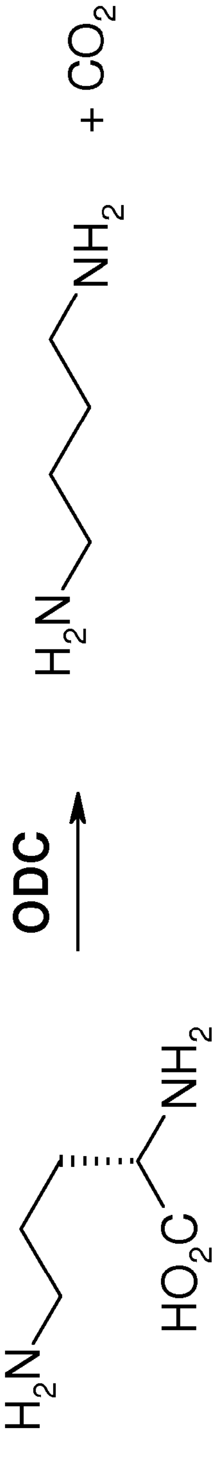
FIG. 1 represents the decarboxilation reaction catalyzed by ODC polypeptides.

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of sequences related to SEQ ID NO: 1, or SEQ ID NO: 2, or SEQ ID NO: 66, or SEQ ID NO: 67, or SEQ ID NO: 88, or SEQ ID NO: 89, or SEQ ID NO: 122, or SEQ ID NO: 123, or SEQ ID NO: 192, or SEQ ID NO: 193

Sequences (full length cDNA, ESTs or genomic) related to SEQ ID NO: 1, or SEQ ID NO: 2, or SEQ ID NO: 66, or SEQ ID NO: 67, or SEQ ID NO: 88, or SEQ ID NO: 89, or SEQ ID NO: 122, or SEQ ID NO: 123, or SEQ ID NO: 192, or SEQ ID NO: 193 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program was used to find regions of local similarity between sequences by comparing nucleic acid or polypeptide sequences to sequence databases and by calculating the statistical significance of matches. For example, the polypeptide encoded by SEQ ID NO: 1, or SEQ ID NO: 66, or SEQ ID NO: 88, or SEQ ID NO: 122, or SEQ ID NO: 192 used in the present invention was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters were adjusted to modify the stringency of the search. For example the E-value were increased to show less stringent matches. This way, short nearly exact matches were identified.

Table A1 provides a list of sequences related to the ODC sequence of SEQ ID NO: 1 and/or SEQ ID NO: 2.

TABLE A1

Examples of ODC polypeptides:

| Name of sequence | Plant Source | Nucleic acid SEQ ID NO | Protein SEQ ID NO |
|---|---|---|---|
| *N. tabacum* ODC_(Nicta_ODC) | *Nicotiana tabacum* | 1 | 2 |
| *A. anophagefferens* 27655 | *Aureococcus anophagefferens* | 3 | 4 |
| *A. formosa* TA15389 | *Aquilegia formosa* | 5 | 6 |
| *C. annuum* AAL83709 | *Capsicum annum* | 7 | 8 |
| *C. reinhardtii* 195696 | *Chlamydomonas reinhardtii* | 9 | 10 |
| *C. reinhardtii* XP 001697502 | *Chlamydomonas reinhardtii* | 11 | 12 |
| *D. stramonium* CAA61121 | *Datura stramonium* | 13 | 14 |
| *G. max* CAD91349 | *Glycine max* | 15 | 16 |
| *G. max* CAD91350 | *Glycine max* | 17 | 18 |
| *L. japonicus* CAE02644 | *Lotus japonicus* | 19 | 20 |
| *N. benthamiana* BAF91874 | *Nicotiana benthamiana* | 21 | 22 |
| *N. glutinosa* AAG45222 | *Nicotiana glutinosa* | 23 | 24 |
| *O. anatinus* XP 001513468 | *Ornithorhynchus anatinus* | 25 | 26 |
| *O. sativa* Os04g0136500 | *Oryza sativa* | 27 | 28 |
| *O. sativa* Os09g0543400 | *Oryza sativa* | 29 | 30 |
| *P. tricornutum* 12642 | *Phaeodactylum tricornutum* | 31 | 32 |
| *S. lycopersicum* TA39775 | *Solanum lycopersicum* | 33 | 34 |
| *S. pombe* CAB45689 | *Schizosaccharomyces pombe* | 35 | 36 |
| *S. tuberosum* TA25894 | *Solanum tuberosum* | 37 | 38 |
| *T. cacao* ABN04356 | *Theobroma cacao* | 39 | 40 |
| *T. maritima* ODC NP 229669 | *Thermotoga maritima* | 41 | 42 |
| *V. carteri* 84542 | *Volvox carteri* | 43 | 44 |
| *V. vinifera* GSVIVT00016806001 | *Vitis vinifera* | 45 | 46 |
| *V. vulnificus* LODC NP 762948 | *Vibrio vulnificus* | 47 | 48 |
| *X. laevi* NP 001080167 | *Xenopus laevi* | 49 | 50 |
| Chlre_ODC | *Chlamydomonas reinhardtii* | 62 | 63 |

Table A2 provides a list of sequences related to the sequence used SEQ ID NO: 66 and/or SEQ ID NO: 67.

TABLE A2

Examples of BIHD1 polypeptide sequences, and encoding nucleic acid sequences:

| Name | Source organism | Public database accession number | Nucleic acid SEQ ID NO | Protein SEQ ID NO |
|---|---|---|---|---|
| Orysa_BIHD1 | *Oryza sativa* | AY524972.1 | 66 | 67 |
| Orysa_BEL1-like II HD | *Oryza sativa* | NM_001073895 | 68 | 69 |

TABLE A2-continued

| Examples of BIHD1 polypeptide sequences, and encoding nucleic acid sequences: | | | | |
|---|---|---|---|---|
| Name | Source organism | Public database accession number | Nucleic acid SEQ ID NO | Protein SEQ ID NO |
| Zeama__BEL1-like HD | *Zea mays* | AC212186.2 | 70 | 71 |
| Gymco__BIHD1 | *Gymnadenia conopsea* | EF051330 | 72 | 73 |
| Soltu__BEL30 | *Solanum tuberosum* | AF406703 | 74 | 75 |
| Vitvi__BEL1-like HD | *Vitis vinifera* | AM436871 | 76 | 77 |
| Medtr__BEL1-like HD | *Medicago truncatula* | AC159535 | 78 | 79 |
| Arath__BHL1 | *Arabidopsis thaliana* | NM__001036413 | 80 | 81 |
| Arath__BHL6 | *Arabidopsis thaliana* | NM__119627 | 82 | 83 |

Table A3 provides a list of nucleic acid sequences related to SEQ ID NO: 88 and/or SEQ ID NO: 89.

TABLE A3

| Examples of MYB30 nucleic acids and polypeptides: | | | |
|---|---|---|---|
| Name | Origin Species | Nucleic acid SEQ ID NO | Protein SEQ ID NO |
| MYB30__1 | *Arabidopsis thaliana* | 88 | 89 |
| At3g28910 | *Arabidopsis thaliana* | 90 | 91 |
| AT1G08810 | *Arabidopsis thaliana* | 92 | 93 |
| AT1G74650 | *Arabidopsis thaliana* | 94 | 95 |
| AT3G47600 | *Arabidopsis thaliana* | 96 | 97 |
| AT5G62470 | *Arabidopsis thaliana* | 98 | 99 |
| LOC__Os03g26130__11973.m07957__CDS | *Oryza sativa* | 100 | 101 |
| LOC__Os07g43580__11977.m08585__CDS | *Oryza sativa* | 102 | 103 |
| LOC__Os08g33940 | *Oryza sativa* | 104 | 105 |
| LOC__Os09g24800__11979.m05634__CDS | *Oryza sativa* | 106 | 107 |
| LOC__Os11g03440__11981.m04539__CDS | *Oryza sativa* | 108 | 109 |
| LOC__Os12g03150__11982.m04313__CDS | *Oryza sativa* | 110 | 111 |
| Poplar MYB30 | *Populus trichocarpa* | 112 | 113 |
| Zea MYB30 | *Zea mays* | 114 | 115 |

Table A4 provides a list of nucleic acid sequences related to SEQ ID NO: 122 and/or SEQ ID NO: 123.

TABLE A4

| Examples of THOM polypeptides: | | |
|---|---|---|
| Plant Source | Nucleic acid SEQ ID NO: | Protein SEQ ID NO: |
| *Solanum lycopersicum* | 1122 | 123 |
| *Populus trichocarpa* | 1134 | 163 |
| *Populus trichocarpa* | 1135 | 164 |
| *Populus trichocarpa* | 1136 | 165 |
| *Solanum lycopersicum* | 1137 | 166 |
| *Solanum lycopersicum* | 1138 | 167 |
| *Zea mays* | 1139 | 168 |
| *Populus trichocarpa* | 1140 | 169 |
| *Populus trichocarpa* | 1141 | 170 |
| *Arabidopsis thaliana* | 1142 | 171 |
| *Arabidopsis thaliana* | 1143 | 172 |
| *Arabidopsis thaliana* | 1144 | 173 |
| *Arabidopsis thaliana* | 1145 | 174 |
| *Oryza sativa* | 1146 | 175 |
| *Populus trichocarpa* | 1147 | 176 |

TABLE A4-continued

| Examples of THOM polypeptides: | | |
|---|---|---|
| Plant Source | Nucleic acid SEQ ID NO: | Protein SEQ ID NO: |
| *Oryza sativa* | 1148 | 177 |
| *Oryza sativa* | 1149 | 178 |
| *Oryza sativa* | 1150 | 179 |
| *Oryza sativa* | 1151 | 180 |
| *Glycine max* | 1152 | 181 |
| *Triticum aestivum* | 1153 | 182 |
| *Medicago truncatula* | 1154 | 183 |
| *Arabidopsis thaliana* | 1155 | 184 |
| *Craterostigma plantagineum* | 1156 | 185 |
| *Pimpinella brachycarpa* | 1157 | 186 |
| *Arabidopsis thaliana* | 1158 | 187 |
| *Silene latifolia* | 1159 | 188 |
| *Populus trichocarpa* | 1160 | 189 |
| *Picea sitchensis* | 1161 | 190 |
| *Glycine max* | 1162 | 191 |

Table A5 provides a list of nucleic acid sequences related to the nucleic acid sequence used in the methods of the present invention.

TABLE A5

Examples of BIHD2 polypeptide sequences, and encoding nucleic acid sequences:

| Name | SEQ ID NO: Nucleic acid | SEQ ID NO: polypeptide |
|---|---|---|
| M. sativa_BHID2 | 192 | 193 |
| A_thaliana_AT2G27990_1_1 | 194 | 195 |
| G_gnemon_AJ318871_1 | 196 | 197 |
| O_sativa_indica_BGIOSIBCE004273_1 | 198 | 199 |
| O_sativa_indica_BGIOSIBCE012511_1 | 200 | 201 |
| O_sativa_indica_BGIOSIBCE019267_1 | 202 | 203 |
| O_sativa_LOC_Os01g62920_1_1 | 204 | 205 |
| O_sativa_LOC_Os03g47730_1_1 | 206 | 207 |
| O_sativa_LOC_Os05g38120_1_1 | 208 | 209 |
| O_sativa_Os01g0848400_1 | 210 | 211 |
| O_sativa_Os03g0680700_1 | 212 | 213 |
| O_sativa_Os05g0455200_1 | 214 | 215 |
| O_sativa_TA50671_4530_1 | 216 | 217 |
| O_sativa_TA55403_4530_1 | 218 | 219 |
| P_trichocarpa_558279_1 | 220 | 221 |
| P_trichocarpa_scaff_IX_1538_1 | 222 | 223 |
| P_trichocarpa_scaff_IX_1539_1 | 224 | 225 |
| S_bicolor_5257689_1 | 226 | 227 |
| S_bicolor_5266102_1 | 228 | 229 |
| S_bicolor_5289797_1 | 230 | 231 |
| TMxxx5170 | 232 | 233 |
| TMxxx6639 | 234 | 235 |
| V_vinifera_GSVIVT00018398001_1 | 236 | 237 |
| V_vinifera_GSVIVT00021404001_1 | 238 | 239 |
| V_vinifera_GSVIVT00024567001_1 | 240 | 241 |
| Z_mays_TA211699_4577_1 | 242 | 243 |
| Z_mays_ZM07MC19826_BFb0096N05_19776_1 | 244 | 245 |

In some instances, sequences have been tentatively assembled and publicly disclosed by research institutions, such as The Institute for Genomic Research (TIGR). The Eukaryotic Gene Orthologs (EGO) database may also be used to identify such sequences, either by keyword search or by using the BLAST algorithm with the nucleic acid or polypeptide sequence of interest. In other instances, special nucleic acid sequence databases have been created for particular organisms, such as by the Joint Genome Institute.

Example 2

Alignment of the Polypeptide Sequences 2.1. Alignment of ODC Polypeptide Sequences Alignment of selected beta/alpha barrel decarboxylase polypeptide sequences was performed using the Clustal W algorithm of progressive alignment (Larking et al. Bioinformatics. 2007 Nov. 1; 23(21):2947-8. Thompson et al. (1997) Nucleic Acids Res 25:4876-4882; Chema et al. (2003). Nucleic Acids Res 31:3497-3500). Default values are for the gap open penalty of 10, for the gap extension penalty of 0,1 and the selected weight matrix is Blosum 62. Proteins alignment is given in FIG. 2 A.

A phylogenetic tree of ODC polypeptides (FIG. 2 B) was constructed using a neighbour-joining clustering algorithm as provided in the Clustal W programme. ODC polypeptides cluster apart of other decarboxylase such as ADC, CANSDC and DAPCD.

2.2 Alignment of BIHD1 Polypeptide Sequences

Multiple sequence alignment of all the BIHD1 polypeptide sequences in Table A2 was performed using the AlignX algorithm (from Vector NTI 10.3, Invitrogen Corporation). The PFAM homeobox domain PF00046 (intergrated into InterPro accession number IPRO001356) and the PFAM POX domain PF07526 (intergrated into InterPro accession number IPRO006563) are identified by X's below the consensus sequence. The SKY and VSLTLGL conserved motifs are also marked by X's under the consensus sequence. The three helices comprised within the homeodomain are shown by a black bold line at the top of the aligned sequences. The PYP and WF conserved amino acids, which are believed to interact directly with the DNA target sequence, are identified by their single amino acid code.

2.3: Alignment of MYB30 Polypeptide Sequences

Alignment of MYB30 polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chema et al. (2003). Nucleic Acids Res 31:3497-3500). Default values are as follows: the gap open penalty is 10, the gap extension penalty is 0,1 and the weight matrix is Blosum 62 (if polypeptides are aligned). Minor manual editing may be done to further optimise the alignment. Sequence conservation among MYB30 polypeptides is essentially in the SANT or in the MYB_DNA-binding domain of the polypeptides, rather than in the region outside of the domain. The MYB30 polypeptides of Table A3 are aligned in FIG. 9.

Figure 2:
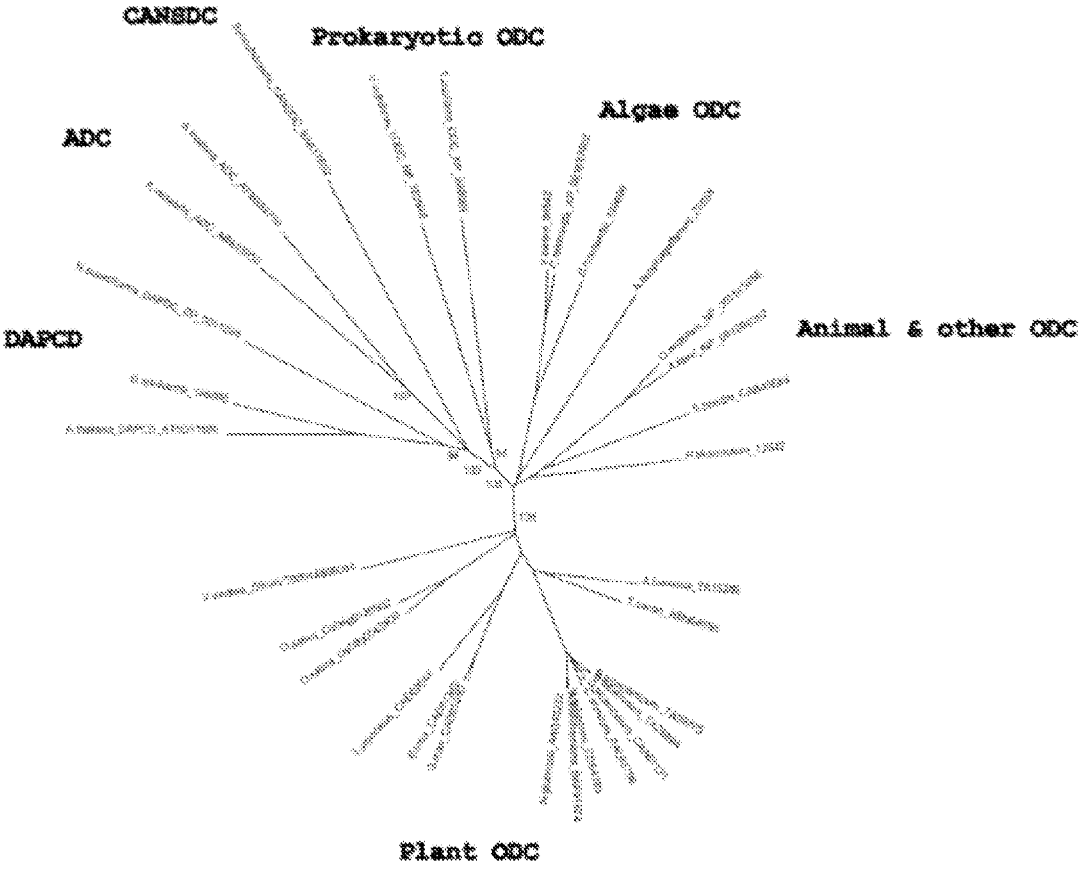
FIG. 2 A Shows an alignment of beta/alpha barrel decarboxylases polypeptides.

Examples of phylogenetic trees of MYB30 polypeptides are given in FIG. 2 of Stracke et al. 2001 (*Arabidopsis thaliana* MYB proteins) and in FIG. 8 and supplementary data of Jiang et al. 2004 (*Arabidopsis thaliana* and *Oryza sativa* MYB proteins).

2.4. Alignment of THOM Polypeptide Sequences

Alignment of polypeptide sequences was performed using the ClustalW 2.0 algorithm of progressive alignment (Thompson et al. (1997) Nucleic Acids Res 25:4876-4882;

Chema et al. (2003). Nucleic Acids Res 31:3497-3500) with standard setting (slow alignment, similarity matrix: Gonnet, gap opening penalty 10, gap extension penalty: 0.2). Minor manual editing was done to further optimise the alignment. Sequence conservation among THOM polypeptides is essentially in the Homeobox domain and the associated HALZ Leucine Zipper domain in the C-terminal part of the polypeptides. The N-terminal HD-ZIP domain is less conserved. The THOM polypeptides are aligned in FIG. 12.

2.5. Alignment of BIHD2 Polypeptide Sequences

Multiple sequence alignment of all the BIHD2 polypeptide sequences in Table A5 was performed using the AlignX algorithm (from Vector NTI 10.3, Invitrogen Corporation). The PFAM homeobox domain PF00046 (intergrated into InterPro accession number IPR0001356) and the PFAM PDX domain PF07526 (intergrated into InterPro accession number IPR0006563) are identified below the consensus sequence. GPFTGY (SEQ ID NO: 249) box, the SNWFINARV (SEQ ID NO: 250) box, the RGLP (SEQ ID NO: 251) box, and the HFLHPYP (SEQ ID NO: 252) conserved boxes or also called motifs are identifiable on the consensus sequence by their single amino acid code. The PYP and WF conserved amino acids, which are believed to interact directly with the DNA target sequence, are underlined.

Example 3

Calculation of Global Percentage Identity

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

Results of the software analysis are shown in Table B1-B4 for the global similarity and identity over the full length of the polypeptide sequences. Percentage identity is given above the diagonal in bold and percentage similarity is given below the diagonal (normal face).

3.1. Ornithine Decarboxylase (ODC) Sequences

The percentage identity between the ODC polypeptide sequences of Table B1 useful in performing the methods of the invention can be as low as 39% amino acid identity compared to SEQ ID NO: 2.

TABLE B1

MatGAT results for global similarity and identity over the full length of the polypeptide sequences. The SEQ ID NO: of the sequences of the proteins used in the comparison is given in Table A1.

| PRT nr | name | 1 | 2 | 3 | 4 | 5 | 6 | 7 | 8 | 9 | 10 | 11 | 12 | 13 | 14 |
|---|---|---|---|---|---|---|---|---|---|---|---|---|---|---|---|
| 1 | *C. reinhardtii* XP_001697502 | | 41 | 39 | 39 | 39 | 39 | 39 | 39 | 38 | 40 | 38 | 43 | 42 | 34 |
| 2 | *S. pombe* CAB45689 | 41 | | 40 | 40 | 40 | 40 | 39 | 39 | 39 | 38 | 37 | 41 | 41 | 35 |
| 3 | *A. formosa* TA15389 | 39 | 40 | | 64 | 65 | 64 | 66 | 65 | 65 | 61 | 56 | 56 | 56 | 53 |
| 4 | *S. lycopersicum* TA39775 | 39 | 40 | 64 | | 97 | 92 | 91 | 90 | 90 | 58 | 56 | 54 | 53 | 49 |
| 5 | *S. tuberosum* TA25894 | 39 | 40 | 65 | 97 | | 92 | 91 | 90 | 90 | 59 | 56 | 54 | 53 | 49 |
| 6 | *C. annuum* AAL83709 | 39 | 40 | 64 | 92 | 92 | | 89 | 88 | 88 | 59 | 56 | 54 | 53 | 48 |
| 7 | *N. tabacum* ODC | 39 | 39 | 66 | 91 | 91 | 89 | | 99 | 98 | 59 | 57 | 56 | 54 | 50 |
| 8 | *N. benthamiana* BAF91874 | 39 | 39 | 65 | 90 | 90 | 88 | 99 | | 97 | 59 | 58 | 56 | 54 | 50 |
| 9 | *N. glutinosa* AAG45222 | 38 | 39 | 65 | 90 | 90 | 88 | 98 | 97 | | 57 | 57 | 55 | 53 | 49 |
| 10 | *G. max* CAD91350 | 40 | 38 | 61 | 58 | 59 | 59 | 59 | 59 | 57 | | 71 | 55 | 57 | 50 |
| 11 | *L. japonicus* CAE02644 | 38 | 37 | 56 | 56 | 56 | 56 | 57 | 58 | 57 | 71 | | 53 | 52 | 48 |
| 12 | *O. sativa* Os09g0543400 | 43 | 41 | 56 | 54 | 54 | 54 | 56 | 56 | 55 | 55 | 53 | | 82 | 52 |
| 13 | *O. sativa* Os04g0136500 | 42 | 41 | 56 | 53 | 53 | 53 | 54 | 54 | 53 | 57 | 52 | 82 | | 51 |
| 14 | *V. vinifera* GSVIVT 00016806001 | 34 | 35 | 53 | 49 | 49 | 48 | 50 | 50 | 49 | 50 | 48 | 52 | 51 | |

3.2. BIHD1 Sequences

The percentage identity between a BIHD1 full length polypeptide sequence as represented by SEQ ID NO: 67 and other BIHD1 polypeptide sequences compiled in Table A2, is of 35% or more.

TABLE B2

MatGAT results for global similarity and identity over the full length of the polypeptide sequences of Table A2.

| | 1 | 2 | 3 | 4 | 5 | 6 | 7 | 8 | 9 |
|---|---|---|---|---|---|---|---|---|---|
| 1. Orysa_BIHD1 | | 78 | 76 | 46 | 42 | 46 | 37 | 35 | 40 |
| 2. Zeama_BEL\like | 87 | | 74 | 44 | 42 | 43 | 36 | 34 | 38 |
| 3. Orysa_BEL1 II | 86 | 84 | | 47 | 42 | 45 | 36 | 36 | 40 |
| 4. Gymco_BIHD1 | 64 | 62 | 64 | | 44 | 47 | 39 | 32 | 41 |
| 5. Soltu_BEL30 | 59 | 58 | 60 | 60 | | 58 | 39 | 34 | 40 |
| 6. Vitvi_BEL1 HD | 62 | 59 | 62 | 60 | 71 | | 42 | 36 | 42 |
| 7. Medtr_BEL1 HD | 56 | 53 | 55 | 59 | 56 | 57 | | 32 | 38 |
| 8. Arath_BHL1 | 52 | 52 | 52 | 49 | 49 | 53 | 49 | | 34 |
| 9. Arath_BHL6 | 52 | 52 | 54 | 54 | 52 | 53 | 52 | 46 | |

3.3. MYB30 Sequences

The percentage identity between the MYB30 polypeptide sequences useful in performing the methods of the invention can be as low as 37.8% amino acid identity compared to SEQ ID NO: 89 (4. MYB30_1).

TABLE B3

| MatGAT results for global similarity and identity over the full length of the polypeptide sequences. | | | | | |
|---|---|---|---|---|---|
| Polypeptide Name | 1 | 2 | 3 | 4 | 5 |
| 1. Poplar\MYB30\ | | 39.4 | 50.5 | 55.7 | 56.0 |
| 2. LOC_Os08g33940 | 51.8 | | 53.7 | 37.8 | 38.1 |
| 3. Zea\MYB30\ | 66.8 | 58.9 | | 49.0 | 49.3 |
| 4. MYB30_1 | 73.7 | 51.6 | 66.9 | | 99.7 |
| 5. At3g28910 | 73.7 | 51.6 | 66.9 | 100.0 | |

3.4. THOM Sequences

The percentage identity between the THOM polypeptide sequences useful in performing the methods of the invention can be as low as 39% amino acid identity compared to SEQ ID NO: 123 (Le_THOM).

Example 4

Identification of Domains

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. The Pfam database is a large collection of protein families, each represented by multiple sequence alignments and hidden Markov models (HMMs). Proteins are generally composed of one or more functional regions, commonly termed domains. Different combinations of domains give rise to the diverse range of proteins found in nature. The identification of domains that occur within proteins can therefore provide insights into their

TABLE B4

MatGAT results for global similarity and identity over the full length of the polypeptide sequences.

| | 1 | 2 | 3 | 4 | 5 | 6 | 7 | 8 | 9 | 10 | 11 |
|---|---|---|---|---|---|---|---|---|---|---|---|
| 1. Pt_40.143 | | 85.3 | 61.5 | 59.9 | 61.0 | 48.1 | 46.0 | 44.4 | 58.9 | 56.4 | 53.8 |
| 2. Pt_II.1260 | 88.3 | | 57.6 | 56.5 | 56.5 | 44.0 | 43.2 | 42.1 | 55.3 | 52.7 | 51.4 |
| 3. Pt_29.72 | 73.2 | 70.6 | | 52.4 | 68.7 | 46.3 | 47.3 | 44.7 | 56.1 | 64.2 | 62.3 |
| 4. SI_TA56840 | 71.1 | 68.6 | 65.2 | | 52.2 | 46.1 | 41.7 | 41.7 | 51.7 | 50.7 | 49.5 |
| 5. SI_TA49906 | 71.8 | 68.0 | 77.2 | 62.9 | | 46.9 | 45.1 | 47.6 | 52.6 | 62.7 | 58.4 |
| 6. Zm_07MC27159 | 55.4 | 53.1 | 54.3 | 56.6 | 57.9 | | 38.4 | 39.1 | 45.5 | 44.8 | 46.8 |
| 7. Pt_XVI.516 | 57.6 | 58.1 | 54.9 | 52.0 | 54.9 | 45.3 | | 86.6 | 39.8 | 43.2 | 41.5 |
| 8. Pt_VI.1202 | 57.7 | 58.6 | 55.5 | 54.3 | 58.6 | 46.0 | 90.4 | | 42.0 | 43.6 | 42.2 |
| 9. At3g60390 | 74.4 | 71.8 | 69.6 | 62.5 | 64.4 | 54.2 | 53.8 | 54.3 | | 50.9 | 48.7 |
| 10. At4g16780 | 67.1 | 65.4 | 75.8 | 61.5 | 77.6 | 54.8 | 50.6 | 53.1 | 63.1 | | 57.7 |
| 11. At5g47370 | 64.8 | 63.4 | 72.5 | 64.3 | 69.6 | 56.8 | 50.6 | 53.1 | 59.9 | 72.2 | |
| 12. At2g44910 | 71.4 | 70.4 | 67.0 | 63.5 | 61.9 | 49.7 | 53.5 | 60.1 | 78.6 | 61.3 | 57.9 |
| 13. Os10g41230 | 62.7 | 61.8 | 59.7 | 56.8 | 58.8 | 58.1 | 52.6 | 56.4 | 56.4 | 56.8 | 55.2 |
| 14. Pt_286586 | 63.4 | 58.6 | 54.3 | 54.9 | 56.8 | 68.0 | 43.3 | 43.9 | 54.2 | 55.9 | 54.3 |
| 15. Os_CAA65456 | 62.4 | 61.7 | 59.8 | 56.3 | 59.2 | 58.2 | 53.8 | 57.7 | 59.9 | 55.9 | 54.7 |
| 16. Os_Q84U86 | 55.2 | 54.4 | 56.2 | 54.9 | 51.3 | 49.0 | 50.0 | 50.3 | 52.9 | 54.2 | 48.1 |
| 17. Os06g04850 | 49.0 | 49.2 | 54.6 | 55.2 | 55.0 | 57.0 | 43.6 | 45.7 | 48.7 | 53.4 | 53.6 |
| 18. Os04g4635012004 | 56.4 | 54.0 | 56.0 | 57.7 | 59.3 | 62.8 | 45.6 | 49.1 | 55.4 | 57.3 | 57.1 |
| 19. Gm_06MC31751 | 57.6 | 58.8 | 57.2 | 55.0 | 58.8 | 49.8 | 55.2 | 57.1 | 57.4 | 50.5 | 52.7 |
| 20. Ta_ABC86568 | 55.0 | 53.1 | 53.3 | 55.9 | 55.4 | 54.1 | 46.8 | 46.6 | 54.2 | 55.5 | 56.4 |
| 21. Mt_DW016069_ps | 48.0 | 46.9 | 51.7 | 51.0 | 53.9 | 62.2 | 48.3 | 53.1 | 46.2 | 52.3 | 52.9 |
| 22. At5g06710 | 55.7 | 53.0 | 54.5 | 53.0 | 52.7 | 45.5 | 64.2 | 64.9 | 56.3 | 54.5 | 50.9 |
| 23. Le_THOM | 71.1 | 68.6 | 65.2 | 100.0 | 62.9 | 56.3 | 51.7 | 54.3 | 63.1 | 61.5 | 64.3 |

| | 12 | 13 | 14 | 15 | 16 | 17 | 18 | 19 | 20 | 21 | 22 | 23 |
|---|---|---|---|---|---|---|---|---|---|---|---|---|
| 1. Pt_40.143 | 57.8 | 47.9 | 63.4 | 48.2 | 42.4 | 40.6 | 46.2 | 41.6 | 39.9 | 40.6 | 41.1 | 59.5 |
| 2. Pt_II.1260 | 54.5 | 45.3 | 57.9 | 45.4 | 39.0 | 38.8 | 44.1 | 39.8 | 39.0 | 38.3 | 36.6 | 56.2 |
| 3. Pt_29.72 | 55.0 | 45.4 | 47.7 | 45.9 | 41.2 | 43.3 | 47.1 | 40.7 | 41.9 | 44.7 | 41.2 | 52.1 |
| 4. SI_TA56840 | 49.9 | 45.4 | 49.1 | 45.8 | 41.6 | 43.2 | 44.6 | 40.9 | 41.6 | 41.3 | 39.9 | 99.7 |
| 5. SI_TA49906 | 52.3 | 45.6 | 50.3 | 46.4 | 39.1 | 41.3 | 46.8 | 43.8 | 42.4 | 46.3 | 39.8 | 51.9 |
| 6. Zm_07MC27159 | 43.2 | 50.8 | 60.8 | 51.2 | 39.5 | 46.1 | 52.4 | 39.2 | 44.5 | 51.1 | 36.7 | 45.4 |
| 7. Pt_XVI.516 | 43.3 | 39.4 | 36.6 | 40.5 | 36.1 | 36.0 | 36.0 | 39.0 | 36.8 | 42.9 | 51.4 | 41.2 |
| 8. Pt_VI.1202 | 45.4 | 40.6 | 36.9 | 41.5 | 36.1 | 38.5 | 35.8 | 40.2 | 34.8 | 46.7 | 53.3 | 41.4 |
| 9. At3g60390 | 64.8 | 44.5 | 48.7 | 46.0 | 37.9 | 38.2 | 43.7 | 41.1 | 39.6 | 38.3 | 39.1 | 51.5 |
| 10. At4g16780 | 49.8 | 44.0 | 47.4 | 44.1 | 41.7 | 44.1 | 45.1 | 38.7 | 40.7 | 42.6 | 41.5 | 50.3 |
| 11. At5g47370 | 47.0 | 41.5 | 47.3 | 42.2 | 37.9 | 41.2 | 43.5 | 40.9 | 39.9 | 42.7 | 36.5 | 49.2 |
| 12. At2g44910 | | 43.6 | 45.9 | 45.1 | 39.6 | 38.8 | 44.8 | 41.9 | 40.9 | 38.7 | 40.2 | 49.6 |
| 13. Os10g41230 | 58.2 | | 41.2 | 98.7 | 38.2 | 41.8 | 41.0 | 37.9 | 37.9 | 37.2 | 37.0 | 45.1 |
| 14. Pt_286586 | 51.6 | 48.4 | | 42.2 | 36.9 | 41.7 | 46.4 | 38.3 | 39.1 | 54.1 | 36.8 | 48.8 |
| 15. Os_CAA65456 | 59.7 | 98.7 | 49.2 | | 38.5 | 43.4 | 41.2 | 37.9 | 38.5 | 38.3 | 38.0 | 45.5 |
| 16. Os_Q84U86 | 56.3 | 53.2 | 44.8 | 53.1 | | 48.3 | 39.4 | 35.0 | 51.2 | 39.3 | 35.2 | 41.3 |
| 17. Os06g04850 | 48.7 | 51.6 | 51.2 | 53.1 | 56.2 | | 43.6 | 34.7 | 53.7 | 41.8 | 35.9 | 42.8 |
| 18. Os04g4635012004 | 56.0 | 52.6 | 54.3 | 52.4 | 48.7 | 54.7 | | 37.4 | 45.3 | 47.4 | 36.1 | 44.3 |
| 19. Gm_06MC31751 | 56.3 | 53.1 | 48.2 | 53.7 | 53.1 | 44.7 | 49.5 | | 35.4 | 39.2 | 38.2 | 39.8 |
| 20. Ta_ABC86568 | 54.4 | 51.0 | 46.6 | 52.1 | 66.6 | 62.7 | 54.8 | 51.8 | | 39.4 | 34.8 | 42.0 |
| 21. Mt_DW016069_ps | 48.1 | 44.8 | 63.9 | 45.7 | 46.8 | 52.7 | 56.7 | 49.2 | 49.8 | | 42.3 | 40.9 |
| 22. At5g06710 | 57.1 | 51.2 | 42.6 | 52.4 | 50.6 | 46.4 | 47.6 | 53.3 | 49.1 | 48.5 | | 39.6 |
| 23. Le_THOM | 62.6 | 56.8 | 54.9 | 56.3 | 54.9 | 55.2 | 57.7 | 53.4 | 57.0 | 51.0 | 53.0 | |

function. Pfam is hosted at the Sanger Institute server in the United Kingdom. Interpro is hosted at the European Bioinformatics Institute in the United Kingdom.

4.1. ODC Sequences

The results of the InterPro scan of the polypeptide sequence as represented by SEQ ID NO: 2 are presented in Table C1.

The following Interpro domains were found in SEQ ID NO: 2: IPRO00183 (Orn/DAP/Arg decarboxylase), IPRO09006 (Alanine/racemase/group/IV/decarboxylase:C-terminal), IPR 002433 (Ornithine decarboxylase).

TABLE C1

InterPro scan results (major accession numbers) of the polypeptide sequence as represented by SEQ ID NO: 2.

| method | Database | Domain AccNumber | Domain shortName | Amino acid coordinates in SEQ ID NO 2 | e-value |
|---|---|---|---|---|---|
| FPrintScan | PRINTS* | PR01179 | ODADCRBXLASE | T[93-111] | 4.2E−33 |
| | | | | T[113-125] | 4.2E−33 |
| | | | | T[216-229] | 4.2E−33 |
| | | | | T[296-315] | 4.2E−33 |
| | | | | T[405-418] | 4.2E−33 |
| HMMPfam | Pfam | PF00278 | Orn_DAP_Arg_deC | T[310-427] | 5.3E−48 |
| HMMPfam | Pfam | PF02784 | Orn_Arg_deC_N | T[71-307] | 3.2E−80 |
| ProfileScan | PROSITE | PS00878 | ODR_DC_2_1 | T[93-111] | 0.0 |
| ProfileScan | PROSITE | PS00879 | ODR_DC_2_2 | T[251-268] | 0.0 |
| FPrintScan | PRINTS* | PR01182 | ORNDCRBXLASE | T[65-89] | 2.6E−66 |
| | | | | T[91-118] | 2.6E−66 |
| | | | | T[135-159] | 2.6E−66 |
| | | | | T[165-187] | 2.6E−66 |
| | | | | T[331-344] | 2.6E−66 |
| | | | | T[372-382] | 2.6E−66 |
| | | | | T[392-405] | 2.6E−66 |
| superfamily | Superfamily** | SSF50621 | Racem_decarbox_C | T[301-419] | 7.93E−16 |

*PRINTS. Attwood et al. (2003) Nucleic Acids Research, 31(1), 400-402.
**Superfamily Gough et al. (2001) J Mol Biol. Nov 2; 313(4): 903-19.

4.2. BIHD1 sequences The results of the InterPro scan of the polypeptide sequence as represented by SEQ ID NO: 67 are presented in Table C2.

TABLE C2

InterPro scan results of the polypeptide sequence as represented by SEQ ID NO: 67

| InterPro accession number and name | Integrated database name | Integrated database accession number | Integrated database accession name |
|---|---|---|---|
| IPR0001356 Homeobox | Pfam | PF00046 | Homeobox |
| | SMART | SM00389 | HOX |
| | ProSite | PS50071 | Homeobox_2 |
| | ProSite | PS00027 | Homeobox_1 |
| IPR0006563 POX | Pfam | PF07526 | POX |
| | SMART | SM00574 | POX |

TABLE C2-continued

InterPro scan results of the polypeptide sequence as represented by SEQ ID NO: 67

| InterPro accession number and name | Integrated database name | Integrated database accession number | Integrated database accession name |
|---|---|---|---|
| No IPR integrated | PANTHER | PTHR11850 | Homeobox protein |

TABLE C2-continued

InterPro scan results of the polypeptide sequence as represented by SEQ ID NO: 67

| InterPro accession number and name | Integrated database name | Integrated database accession number | Integrated database accession name |
|---|---|---|---|
| | PANTHER | PTHR11850:SF14 | transcription factors BEL1 homeotic protein |

4.3. MYB30 Sequences

The results of the InterPro scan of the polypeptide sequence as represented by SEQ ID NO: 89 are presented in Table C3.

TABLE C3

InterPro scan results (major accession numbers) of the polypeptide sequence as represented by SEQ ID NO: 89.

| Database | Accession number | Accession name | e-value | Amino acid coordinates on SEQ ID NO 89 |
|---|---|---|---|---|
| HMMPfam | PF00249 | Myb_DNA-binding | 7.6e−11/1.3e−10 | [14-61]T/[67-112]T |
| HMMSmart | SM00717 | SANT | 1.6e−14/2.5e−15 | [13-63]T/[66-114]T |
| ProfileScan | PS00334 | MYB_2 | 8e−5 | [89-112]T |

TABLE C3-continued

InterPro scan results (major accession numbers) of the polypeptide sequence as represented by SEQ ID NO: 89.

| Database | Accession number | Accession name | e-value | Amino acid coordinates on SEQ ID NO 89 |
|---|---|---|---|---|
| ProfileScan | PS50090 | MYB_3 | 17.058/15.179 | [9-61]T/[62-112]T |
| PANTHER | PTHR10641 | MYB-RELATED | 5e−92 | [3-159]T |

4.4. THOM Sequences

The results of the InterPro scan of the polypeptide sequence as represented by SEQ ID NO: 123 are presented in Table C4.

TABLE C4

InterPro scan results (major accession numbers) of the polypeptide sequence as represented by SEQ ID NO: 123.

| Database | Accession number | Accession name | Amino acid coordinates on SEQ ID NO 123 |
|---|---|---|---|
| InterPro | IPR000047 | Helix-turn-helix motif, lambda-like repressor | |
| PRINTS | PR00031 | HTHREPRESSR | 157-182 |
| InterPro | IPR001356 | Homeobox | |
| PRODOM | PD000010 | Q7XC54_EEEEE_Q7XC54 | 130-187 |
| PRINTS | PR00024 | HOMEOBOX | 165-184 |
| PFAM | PF00046 | Homeobox | 131-185 |
| SMART | SM00389 | HOX | 128-190 |
| PROSITE | PS00027 | HOMEOBOX_1 | 161-184 |
| InterPro | IPR003106 | Leucine zipper, homeobox-associated | |
| PFAM | PF02183 | HALZ | 186-230 |
| SMART | SM00340 | HALZ | 186-229 |
| InterPro | IPR006712 | HD-ZIP protein, N-terminal | |
| PFAM | PF04618 | HD-ZIP_N | 1-107 |
| InterPro | IPR012287 | Homeodomain-related | |
| GENE3D | G3DSA:1.10.10.60 | no description | 132-184 |
| PANTHER | PTHR19418 | HOMEOBOX PROTEIN | 103-191 |

The presence of conserved domains in SEQ ID NO: 123 was determined by searching in the Pfam database (Release 1.7) Finn et al. Nucleic Acids Research (2008) Database Issue 36:D281-D288

The results of the Pfam search of the polypeptide sequence as represented by SEQ ID NO: 193 are detailed in Table C5.

TABLE C5

| Database | Name | Amino acid coordinate start | Amino acid coordinate end |
|---|---|---|---|
| PF07526 | POX | 136 | 261 |
| PF00046 | Homeobox | 307 | 365 |

Example 5

Subcellular Localisation Prediction of the BIHD1 Polypeptide Sequences and BIHD2 Polypeptide Sequences Experimental methods for protein localization range from immunolocalization to tagging of proteins using green fluorescent protein (GFP) or beta-glucuronidase (GUS). For example, the *Oryza sativa* BIHD1 polypeptide has been found to mainly localized in the nucleus of plant cells, using a GFP-based approach and tranbsient expression in onion cells (Luo et al. (2005) supra).

Computational prediction of protein localisation from sequence data was also performed. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM and others.

LOCtree is an algorithm that can predict the subcellular localization and DNA-binding propensity of non-membrane proteins in non-plant and plant eukaryotes as well as prokaryotes. LOCtree classifies eukaryotic animal proteins into one of five subcellular classes, while plant proteins are classified into one of six classes and prokaryotic proteins are classified into one of three classes.

Whenever available, LOCtree also reports predictions based on the following: 1) Nuclear localization signals found by the PredictNLS algorithm, 2) Localization inferred using Prosite motifs and Pfam domains found in the protein, and 3) SWISS-PROT keywords associated with a protein. Localization is inferred in the last two cases using the entropy-based LOCkey algorithm. The software is hosted at the University of Columbia, USA.

Motif and keyword based prediction of subcellular localization of a BIHD1 polypeptide as represented by SEQ ID NO: 67, using LOCkey:

| Predicted Localization | Confidence | Alternative prediction | SWISS-PROT keywords used to assign localization |
|---|---|---|---|
| Nuclear | 100 | — | Homeobox, DNA-binding, Transcription regulation, Nuclear protein, Transcription, Repressor |

Example 6

Prediction of Secondary Structure Features of the BIHD1 Polypeptide Sequences and BIHD2 Polypeptide Sequences Coiled coils usually contain a repeated seven amino acid residue pattern called heptad repeats. Coiled coils are important to identify for protein-protein interactions, such as oligomerization, either of identical proteins, of proteins of the same family, or of unrelated proteins. Recently much progress has been made in computational prediction of coiled coils from sequence data. Many algorithms well known to a person skilled in the art are available at the ExPASy Proteomics tools. One of them, COILS, is a program that compares a sequence to a database of known parallel two-stranded coiled-coils and derives a similarity score. By comparing this score to the distribution of scores in globular and coiled-coil proteins, the program then calculates the probability that the sequence will adopt a coiled-coil conformation.

6.1. BIHD1 Sequences

Figure 5:
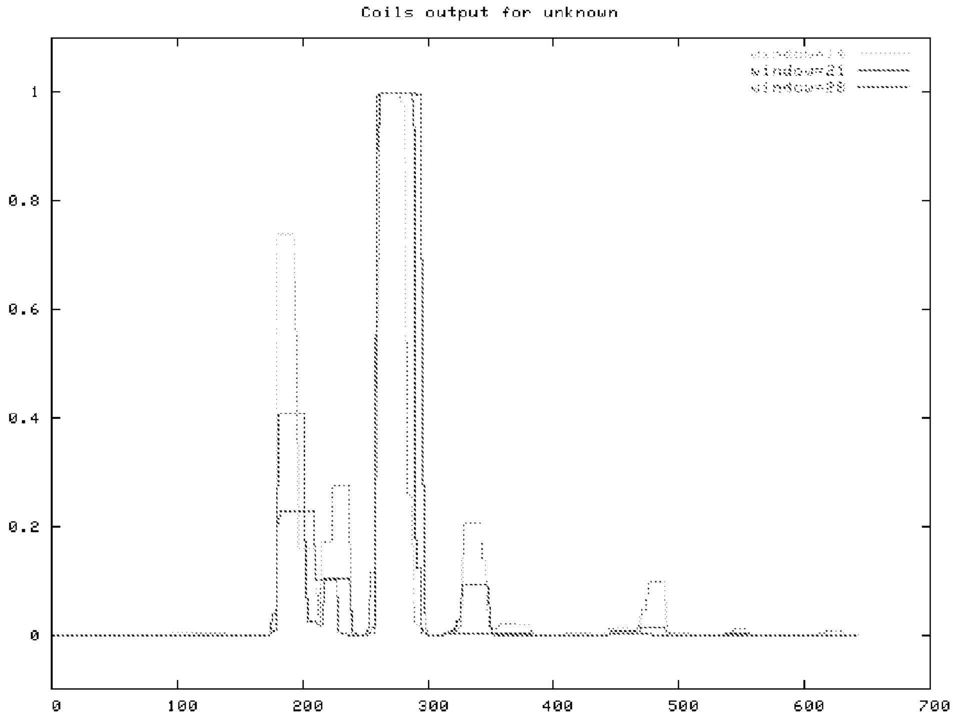
FIG. 5 shows the graphical output of the COILS algorithm predicting at least one coiled coil domain in the BIHD1 polypeptide as represented by SEQ ID NO: 67. The X axis represents the amino acid residue coordinates, the Y axis the probability (ranging from 0 to 1) that a coiled coil domain is present, and the three lines, the three windows (14, 21, 28) examined.
Figure 6:
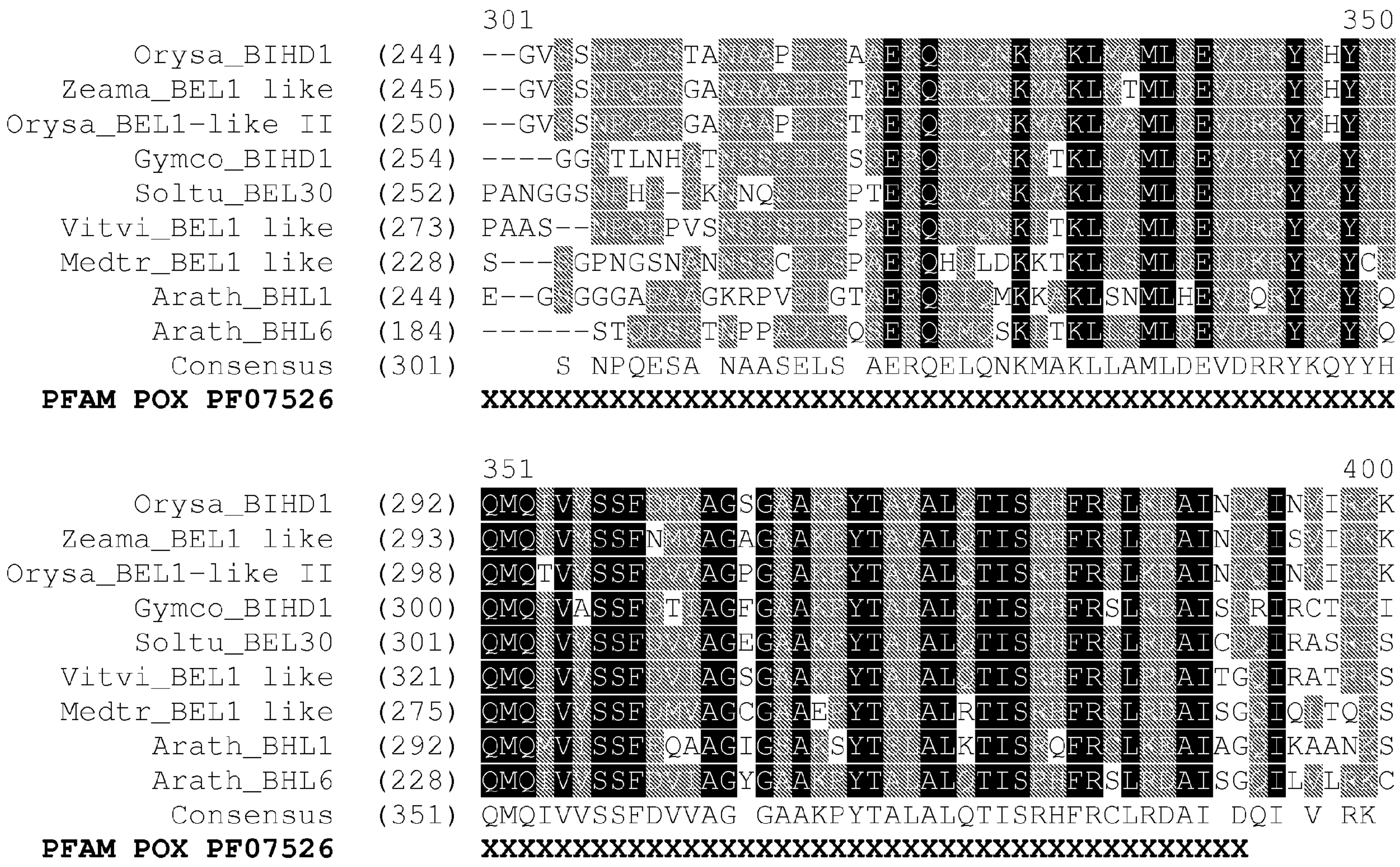
FIG. 6 shows an AlignX (from Vector NTI 10.3, Invitrogen Corporation) multiple sequence alignment of the BIHD1 polypeptides from Table A2. The PFAM homeobox domain PF00046 (intergrated into InterPro accession number IPRO001356) and the PFAM POX domain PF07526 (intergrated into InterPro accession number IPRO006563) are identified by X's below the consensus sequence. The SKY and VSLTLGL conserved motifs are also marked by X's under the consensus sequence. The three helices comprised within the homeodomain are shown by a black bold line at the top of the aligned sequences. The PYP and WF conserved amino acids, which are believed to interact directly with the DNA target sequence, are identified by their single amino acid code.
Figure 6:
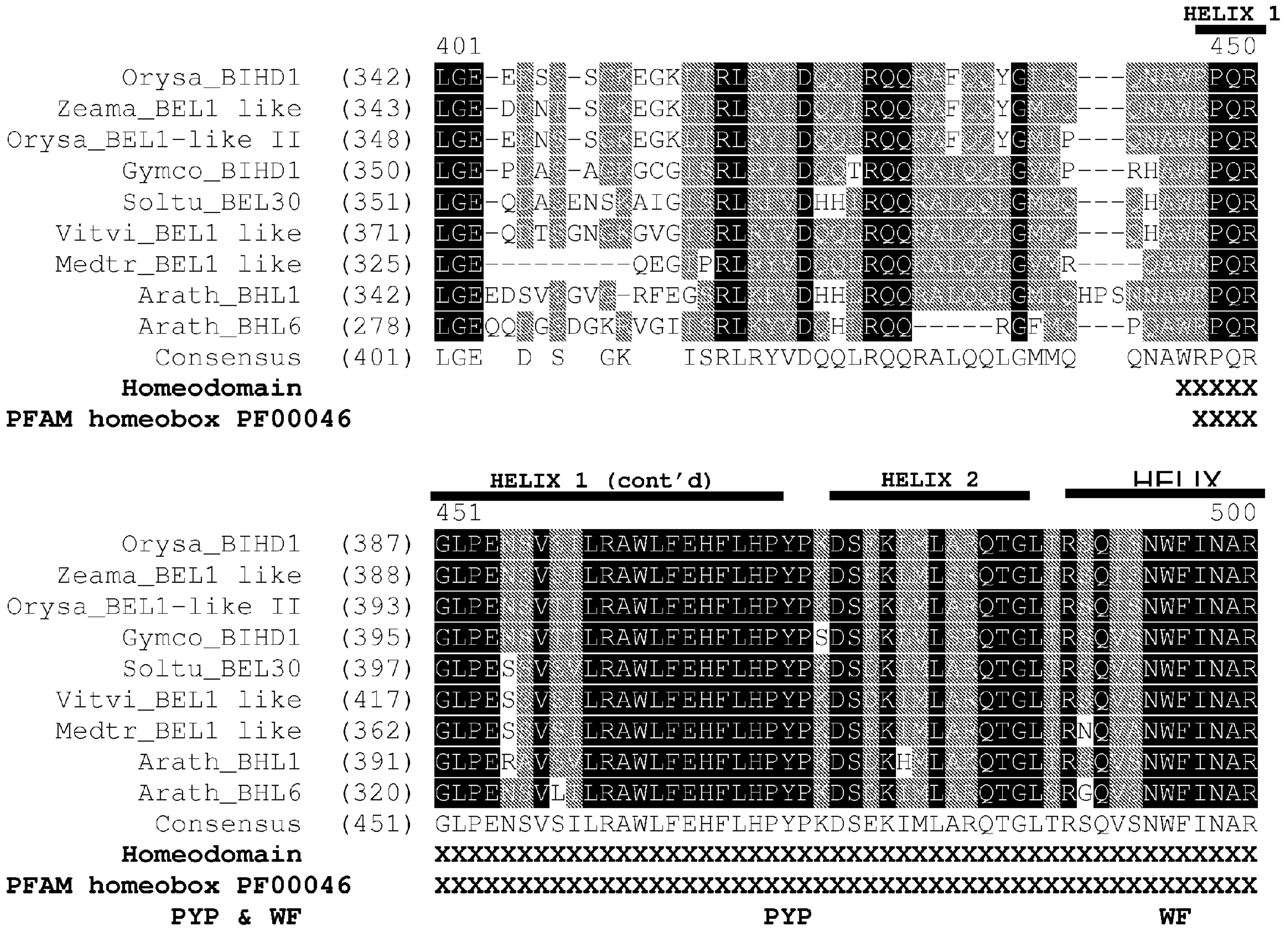
Figure 6:
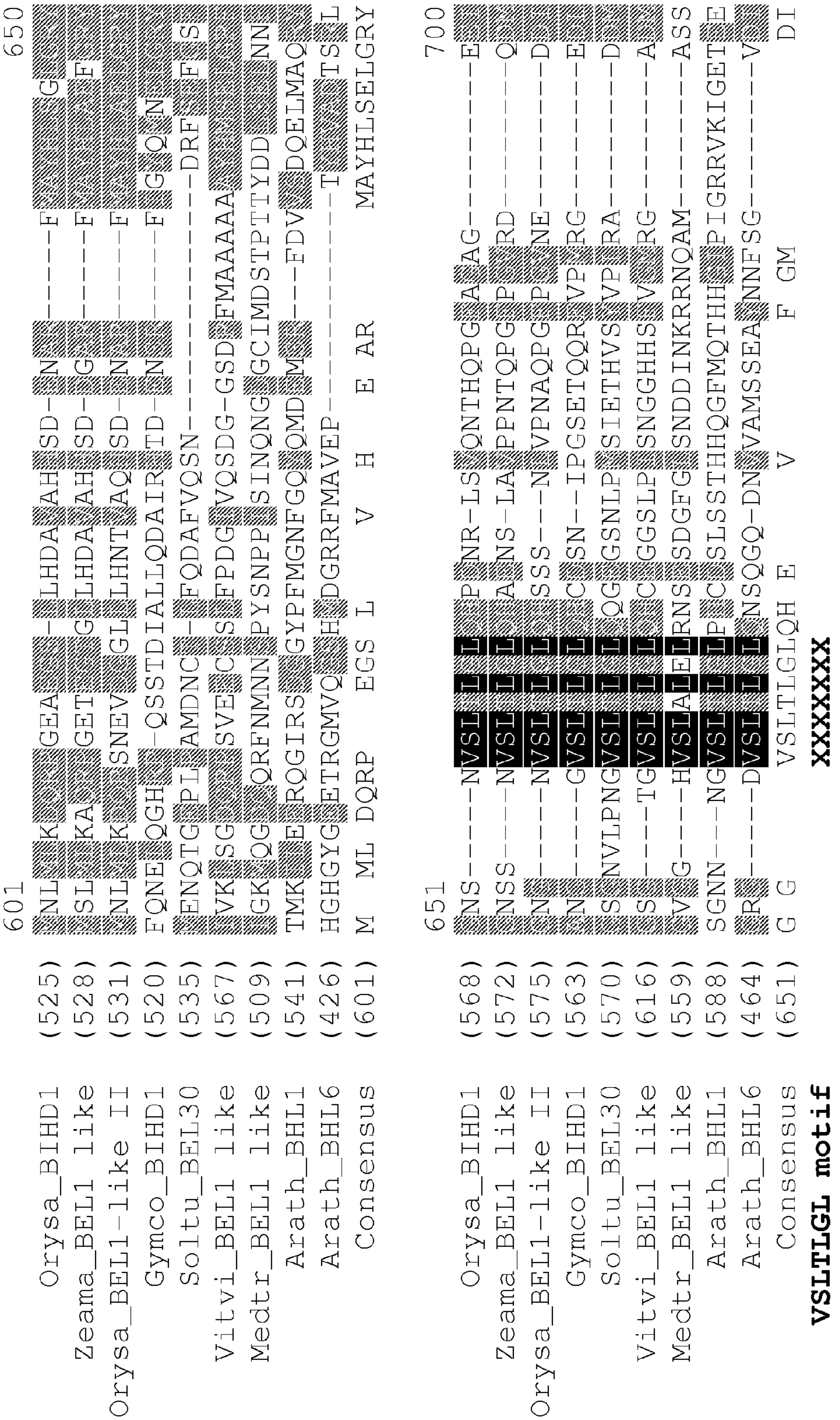
Figure 6:
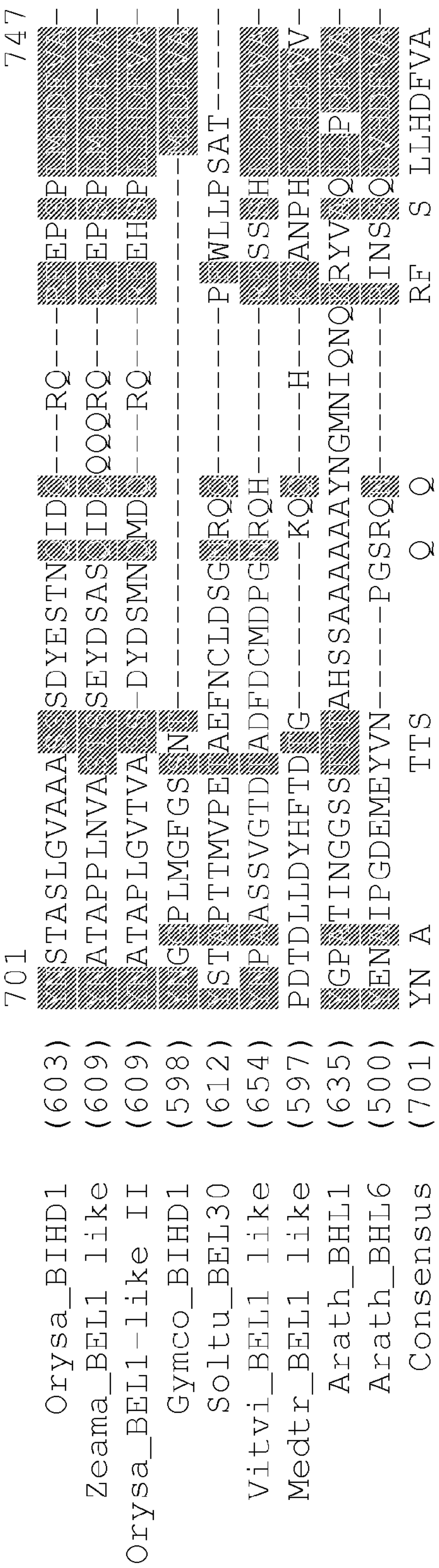
Figure 7:
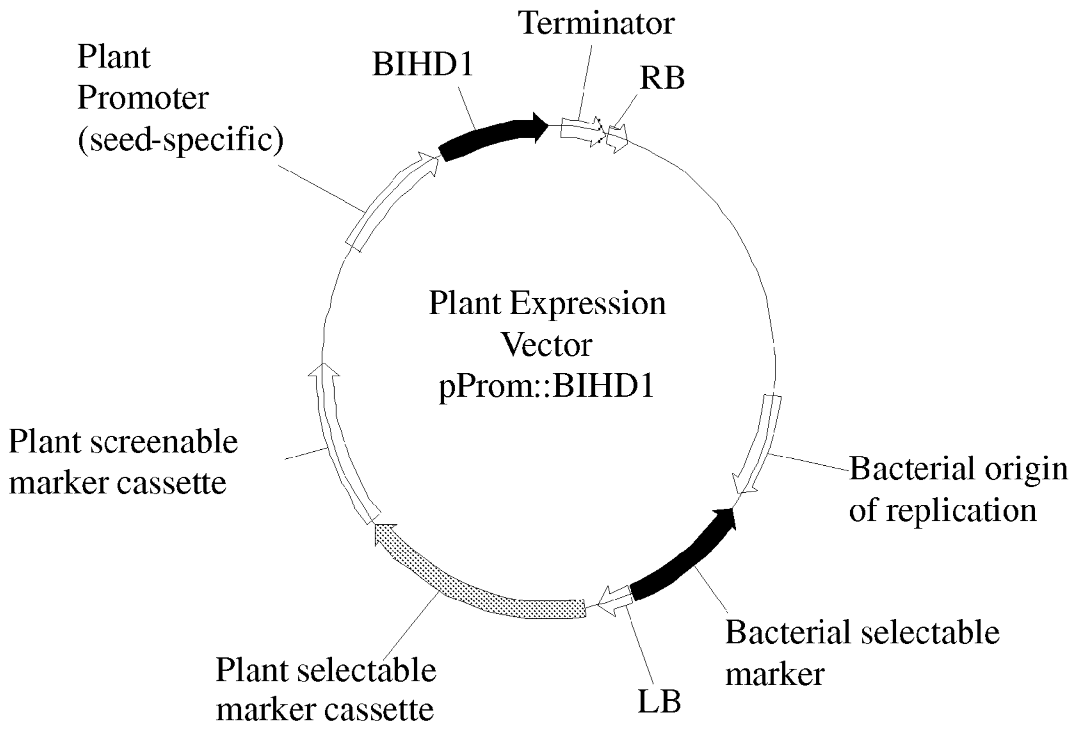
FIG. 7 shows the binary vector for increased expression in *Oryza sativa* of a nucleic acid sequence encoding a BIHD1 polypeptide under the control of a seed-specific promoter (pWSI18 or pRAB21) from rice.

The BIHD1 polypeptide as represented by SEQ ID NO: 67, has at least one predicted coiled coil domain, with a high probability, in all three windows (14, 21 and 28) examined. In Table D, the residue coordinates, residues, the three windows and corresponding probability values are shown. In FIG. 5, is the graphical output of the COILS algorithm on the polypeptide as represented by SEQ ID NO: 67, where the predicted coiled coil is clearly visible in all three windows (as represented by the three lines).

TABLE D

Numerical output of the COILS algorithm on the polypeptide as represented by SEQ ID NO: 67. The residue coordinates (#), residues, the three windows and corresponding probability values are shown.

| # | Residue | Window = 14 | Prob | Window = 21 | Prob | Window = 28 | Prob |
|---|---|---|---|---|---|---|---|
| 259 | E | b | 0.570 | b | 0.895 | b | 0.995 |
| 260 | I | c | 0.570 | c | 0.895 | c | 0.995 |
| 261 | S | d | 0.808 | d | 0.991 | d | 0.996 |
| 262 | A | e | 0.995 | e | 0.997 | e | 0.999 |
| 263 | A | f | 0.997 | f | 0.998 | f | 0.999 |
| 264 | E | g | 0.997 | g | 0.999 | g | 0.999 |
| 265 | K | a | 0.997 | a | 0.999 | a | 0.999 |
| 266 | Q | b | 0.997 | b | 0.999 | b | 0.999 |
| 267 | E | c | 0.997 | c | 0.999 | c | 0.999 |
| 268 | L | d | 0.997 | d | 0.999 | d | 0.999 |
| 269 | Q | e | 0.997 | e | 0.999 | e | 0.999 |
| 270 | N | f | 0.997 | f | 0.999 | f | 0.999 |
| 271 | K | g | 0.997 | g | 0.999 | g | 0.999 |
| 272 | M | a | 0.997 | a | 0.999 | a | 0.999 |
| 273 | A | b | 0.997 | b | 0.999 | b | 0.999 |
| 274 | K | c | 0.997 | c | 0.999 | c | 0.999 |
| 275 | L | d | 0.997 | d | 0.999 | d | 0.999 |
| 276 | M | e | 0.997 | e | 0.999 | e | 0.999 |
| 277 | A | f | 0.997 | f | 0.999 | f | 0.999 |
| 278 | M | g | 0.978 | g | 0.999 | g | 0.999 |
| 279 | L | a | 0.978 | a | 0.999 | a | 0.999 |
| 280 | D | b | 0.975 | b | 0.999 | b | 0.999 |
| 281 | E | c | 0.975 | c | 0.999 | c | 0.999 |
| 282 | V | d | 0.771 | d | 0.999 | d | 0.999 |
| 283 | D | e | 0.315 | e | 0.999 | e | 0.999 |
| 284 | R | f | 0.261 | f | 0.999 | f | 0.999 |
| 285 | K | g | 0.261 | g | 0.998 | g | 0.999 |
| 286 | Y | a | 0.257 | a | 0.998 | a | 0.999 |
| 287 | K | b | 0.257 | b | 0.998 | b | 0.999 |
| 288 | H | c | 0.075 | c | 0.972 | c | 0.999 |
| 289 | Y | d | 0.027 | d | 0.899 | d | 0.999 |
| 290 | Y | e | 0.019 | e | 0.228 | e | 0.998 |
| 291 | H | f | 0.019 | f | 0.122 | f | 0.995 |
| 292 | Q | g | 0.019 | g | 0.122 | g | 0.995 |
| 293 | M | a | 0.015 | a | 0.122 | a | 0.995 |
| 294 | Q | b | 0.015 | b | 0.122 | b | 0.995 |
| 295 | I | c | 0.002 | c | 0.021 | c | 0.883 |
| 296 | V | d | 0.002 | d | 0.005 | d | 0.500 |
| 297 | V | e | 0.001 | e | 0.002 | e | 0.055 |

6.2. BIHD2 Sequences

The presence of Coiled coil domains in a BIHD2 polypeptide may be determine by any one of the techniques and methods above-mentioned.

Example 7

Topology Prediction of the THOM Polypeptide Sequences

TargetP 1.1 predicts the subcellular location of eukaryotic proteins (Emanuelsson et al., Nature Protocols 2, 953-971, (2007)). The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 123 are presented Table E. The "plant" organism group has been selected, no cutoffs defined, and the predicted length of the transit peptide requested. The subcellular localization of the polypeptide sequence as represented by SEQ ID NO: 123 may be the cytoplasm or nucleus, no transit peptide is predicted.

TABLE E

TargetP 1.1 analysis of the polypeptide sequence as represented by SEQ ID NO: 123;

| Name | Length | cTP | mTP | SP | other | Loc | RC |
|---|---|---|---|---|---|---|---|
| Sequence | 286 | 0.414 | 0.125 | 0.051 | 0.538 | — | 5 |
| Cutoff | | 0.000 | 0.000 | 0.000 | 0.000 | | |

cTP, probability of chloroplastic location;
mTP, probability of mitochondrial location;
SP, probability of secretory pathway signal peptide;
other, probability of other location (cytoplasm, nucleus);
Loc, predicted location;
RC, Reliability class When using the PLOC algorithm (Park and Kanehisa, Bioinformatics, 19, 1656-1663, 2003), the THOM polypeptide is predicted to have a nuclear localisation.

Many other algorithms can be used to perform such analyses, including:

- ChloroP 1.1 hosted on the server of the Technical University of Denmark;
- Protein Prowler Subcellular Localisation Predictor version 1.2 hosted on the server of the Institute for Molecular Bioscience, University of Queensland, Brisbane, Australia;
- PENCE Proteome Analyst PA-GOSUB 2.5 hosted on the server of the University of Alberta, Edmonton, Alberta, Canada;
- TMHMM, hosted on the server of the Technical University of Denmark
- PSORT (URL: psort.org)

Example 8

Functional Assays 8.1. ODC Sequences

The ornithine decarboxylase activity of SEQ ID NO: 2 is tested according to Plant Physiol. Vol. 116, 1998. Briefly, decarboxilation of readiollabelled ornthine in transgenic cells is measured over a period of 24 h. The incorporation of [U-14C]Orn into labeled putrescine is measured using a scintillation counter. A modified procedure from Minocha et al. (1994) suitable to TLC (thin-layer chromatography) separation using larger quantities of tissue is used for dansylation and quantitation of polyamines.

8.2. BIHD1 Sequences

BIHD1 polypeptides useful in the methods of the present invention (at least in their native form) typically, but not necessarily, have transcriptional regulatory activity. DNA-binding activity may readily be determined in vitro or in vivo using techniques well known in the art (for example in Current Protocols in Molecular Biology, Volumes 1 and 2, Ausubel et al. (1994), Current Protocols). The recombinant BIHD1 from *Oryza sativa* expressed in *Escherichia coli* binds to the TGTCA motif that is the characteristic cis-element DNA sequence of the homeodomain transcription factors (Luo et al. (2005) supra).

8.3. MYB30 Sequences

MYB30 protein activity can be assayed as described by Li and Parish (1995). The MYB30 coding sequence is cloned in frame with the T7 gene 10 leader sequence and expressed in *E. coli*. The proteins are purified and analysed in a mobility retardation assay, using $^{32}$P-labeled c-myb binding site (MBS) and the binding site of the maize P gene product (PBS). In this way, the binding properties of MYB30 polypeptides and portions thereof to MBS and PBS site is determined.

8.4. THOM Polypeptides

Electrophoretic mobility shift assays may be performed according to Meijer et al. (2000) and Meijer et al. (Plant J. 11, 263-276, 1997), exemplified with rice HD-Zip proteins: HD-Zip cDNA sequences were cloned in-frame with the GST-encoding sequence in an *E. coli* expression vector. Overnight *E. coli* cultures (100 ml) containing the expression constructs were induced by addition of IPTG to 0.1 mM. After 2 hrs of growth at 37° C., cells were pelleted, resuspended in 1 ml of NET-N buffer (20 mM TRIS-HCl pH 8.0, 100 mM NaCl, 1 mM EDTA, 0.5% Nonidet-P40, 1 mM PMSF, 0.5 μM trypsin inhibitor, 1 μM leupeptin), and lysed by mild sonication. Following centrifugation, 400 μl of the clarified extract was added to 150 μl of a 50% glutathione-Sepharose 4B (Pharmacia) slurry in NET-N buffer. After 60-min incubation at 4° C., the Sepharose beads were washed four times with NET-N buffer. GST fusion proteins were then eluted by incubation for 15 min at room temperature with 300 μl of reduced glutathione (10 mM) in 50 mM TRIS-HCl buffer pH 8, and frozen in liquid nitrogen after addition of glycerol to 10%. EMSA reactions contained 3 μg *E. coli* protein extract, 0.1 ng $^{32}$P-end-labeled probe AH1 (CAATAATTG), variable amounts of competitor DNAs and 3 μg poly-(dldC)-poly-(dldC) in 10 1 μl nuclear extraction buffer. The reaction mixtures were incubated for 20 min at room temperature and subsequently loaded under tension (10 V $cm^{-1}$) on 5% acrylamide/bisacrylamide (37.5:1) gels in 0.5× Tris-borate/EDTA buffer. Gels were dried on Whatman DE81 paper and autoradiographed.

8.5. BIHD2 Sequences

BIHD2 polypeptides useful in the methods of the present invention (at least in their native form) typically, but not necessarily, have transcriptional regulatory activity. DNA-binding activity may readily be determined in vitro or in vivo using techniques well known in the art (for example in Current Protocols in Molecular Biology, Volumes 1 and 2, Ausubel et al. (1994), Current Protocols). The recombinant BIHD1 from *Oryza sativa* expressed in *Escherichia coli* binds to the TGTCA motif that is the characteristic cis-element DNA sequence of the homeodomain transcription factors (Luo et al. (2005) supra).

Example 9

Gene Cloning and Expression Vector Construction

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

9.1. ODC Sequences

The nucleic acid sequence used in the methods of the invention was amplified by PCR using as template a custom-made *Nicotiana tabacum* seedlings cDNA library. PCR was performed using Hifi Taq DNA polymerase in standard conditions, using 200 ng of template in a 50 μl PCR mix. The primers used were SEQ ID NO: 59; sense: 5'-ggggacaagtttgtacaaaaaag caggcttaaacaatggccggccaaaca-3' and SEQ ID NO: 60; reverse, complementary: 5'-ggggaccactttgtacaagaaagctgggttacaggtggttcatcagcttg-3', which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", p Nicta_ODC. Plasmid pDONR201 was purchased from Invitrogen, as part of the Gateway® technology.

The entry clone comprising SEQ ID NO: 1 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 61) for constitutive expression was located upstream of this Gateway cassette.

Figure 3:
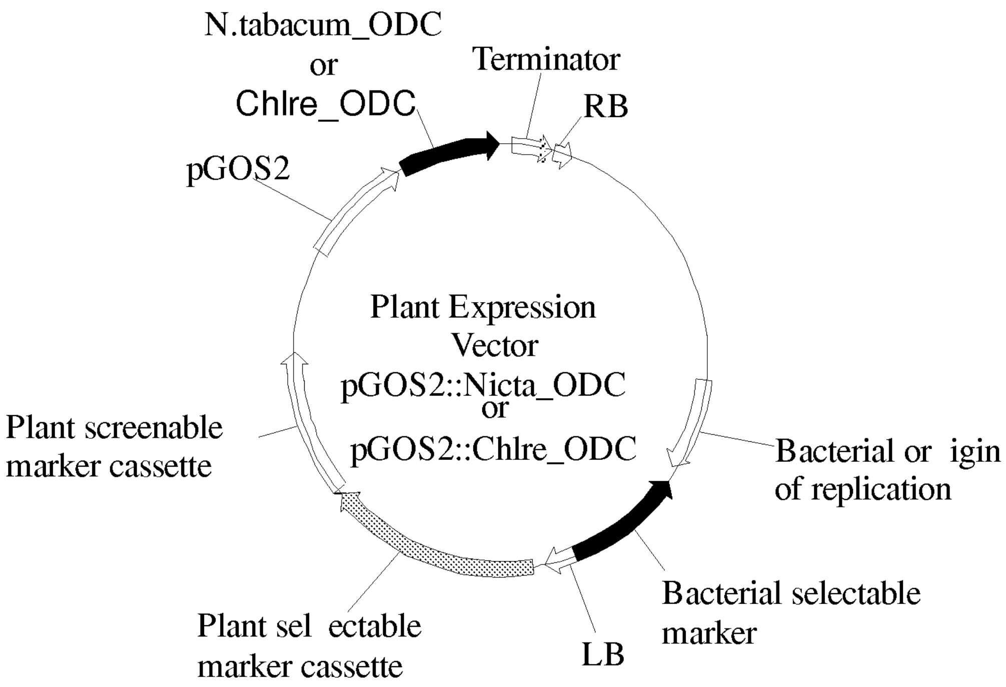
FIG. 3 represents the binary vector for increased expression in *Oryza sativa* of a ODC-encoding nucleic acids under the control of a rice GOS2 promoter (pGOS2).
Figure 4:
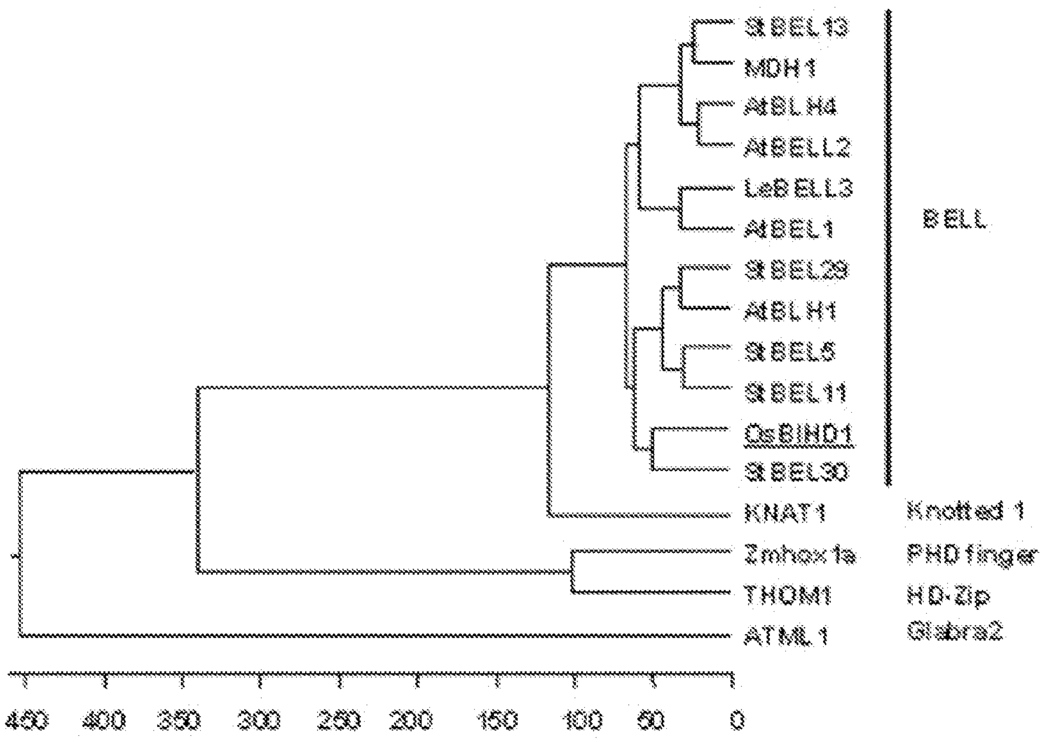
FIG. 4 is a phylogenetic tree from Luo et al. (2005; Plant Biol 7: 459-468). It shows that the rice BIHD1 polypeptide clusters with the BELL 1 subfamily of homeodomain transcription factors, and not with the other subfamilies such as the Knotted1, glabra2, HD-Zip and PHD-HDrobust homeodomain polypeptides.

After the LR recombination step, the resulting expression vector pGOS2::Nicta_ODC (FIG. 3) was transformed into *Agrobacterium* strain LBA4044 according to methods well known in the art.

Similarly to the cloning procedure described above, SEQ ID NO: 62 was amplified by PCR using as template a custom-made *Chlamydomonas* reinhardtii cDNA library. The primers used were: 5'-ggggacaagtttgtacaaaaaagcaggcttaaacaatggaaggaattgccaactc-3' (sense) and 5'-ggggaccactttgtacaagaaagctgggtaatcgcgaagtgctgtcac-3' (complementary). SEQ ID NO: 62 was transferred by an LR recombination step to the expression vector pGOS2:Chlre_ODC, where the expression of Chlre_ODC is under the control of the GOS2 promoter.

9.2. BIHD1 Sequences

The *Oryza sativa* cDNA encoding a BIHD1 polypeptide sequence as represented by SEQ ID NO: 2 was amplified by PCR using as template cDNA synthesized from mRNA extracted from Orysa sativa at different stages of growth, and under different growth conditions. The following primers, which include the AttB sites for Gateway recombination, were used for PCR amplification: prm08627 (SEQ ID NO: 68, sense): 5'-ggggacaagtttgtacaaaaaagcagg cttaaacaatggctacttactactcgag-3' and prm08628 (SEQ ID NO: 69, reverse, complementary): 5'-ggggaccactttgtacaagaaagctgggtttaggccacaaaatcat-3'.

PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombined in vivo with the pDONR201 plasmid to produce, according to the Gateway terminology, an "entry clone". Plasmid pDONR201 was purchased from Invitrogen, as part of the Gateway® technology.

The entry clone comprising SEQ ID NO: 66 was subsequently used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. Two expression vectors differing the A rice WSI18 promoter (SEQ ID NO: 84) for late embryo specific expression was located upstream of this Gateway cassette. In a second expression vector, another promoter, a rice RAB21 promoter (SEQ ID NO: 85) for seed-specific expression, was located upstream of the Gateway cassette.

After the LR recombination step, the resulting expression vectors for seed-specific expression (FIG. 5) were independently transformed into *Agrobacterium* strain LBA4044 according to methods well known in the art.

9.3. MYB30 Sequences

The nucleic acid sequence of MYB30_1 was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 μl PCR mix. The primers used were SEQ ID NO: 116 (sense): 5'-ggggaccactttgtacaagaaagctgggtccatgtgattaaagcaaactcttca-3' and SEQ ID NO: 117 (reverse, complementary): 5'-ggggaccactttgtacaagaaagctgggtccat gtgattaaagcaaactcttca-3', which include the AttB sites for Gateway recombination. The amplified PCR fragment was purified, also using standard methods. The first step of the Gateway procedure, the BP reaction, was then performed, during which the PCR fragment recombines in vivo with the pDONR201 plasmid to produce, according to the Gateway terminology, an "entry clone", pMYB30. Plasmid pDONR201 was purchased from Invitrogen, as part of the Gateway® technology.

The entry clone comprising SEQ ID NO: 88 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice protochlorophyllide reductase promoter (pPcR) (SEQ ID NO: 118) for expression in green tissue was located upstream of this Gateway cassette.

After the LR recombination step, the resulting expression vector pPcR::MYB30 (FIG. 10) was transformed into *Agrobacterium* strain LBA4044 according to methods well known in the art.

9.4. THOM Polypeptides

The nucleic acid sequence used in the methods of the invention was amplified by PCR using as template a custom-made tomato seedlings cDNA library (in pCMV Sport 6.0; Invitrogen, Paisley, UK). PCR was performed using Hifi Taq DNA polymerase in standard conditions, using 200 ng of template in a 50 μl PCR mix. The primers used were prm10162 (SEQ ID NO: 132; sense, start codon in bold): 5'-gggacaagtttgtacaaaaaagcaggcttaaacaatgag tagtgaaaaagaagatgg-3' and prm10163 (SEQ ID NO: 133; reverse, complementary): 5'-ggggaccactttgtacaagaaagctgggtacggatccatatttatctttc-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an “entry clone”, pTHOM. Plasmid pDONR201 was purchased from Invitrogen, as part of the Gateway® technology.

The entry clone comprising SEQ ID NO: 122 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 131) for constitutive specific expression was located upstream of this Gateway cassette.

Figure 13:
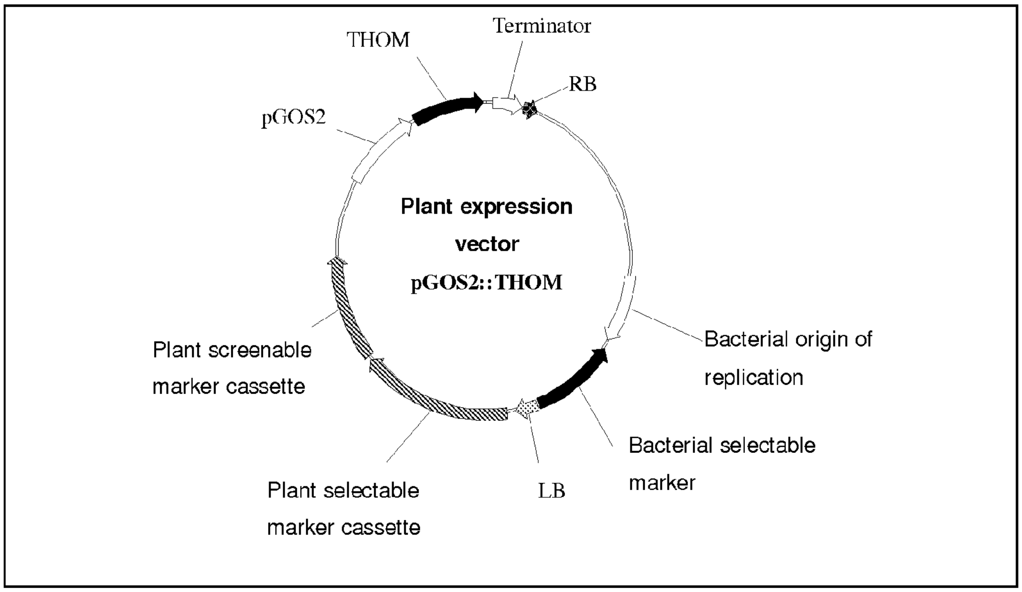
FIG. 13 represents the binary vector used for increased expression in *Oryza sativa* of a THOM-encoding nucleic acid under the control of a rice GOS2 promoter (pGOS2)

After the LR recombination step, the resulting expression vector pGOS2::THOM (FIG. 13) was transformed into *Agrobacterium* strain LBA4044 according to methods well known in the art.

9.5. BIHD2 Polypeptides

The *Medicago sativa* cDNA encoding a BIHD2 polynucleotide sequence as represented by SEQ ID NO: 193 was amplified by PCR using as template cDNA synthesized from mRNA extracted from *Medicago sativa* at different stages of growth, and under different growth conditions. The following primers, which include the AttB sites for Gateway recombination, were used for PCR amplification: prm08627 (SEQ ID NO: 212, sense): 5'-ggggacaagttt gtacaaaaaagcaggcttaaacaatggctgaggagggtttt-3' and prm08628 (SEQ ID NO: 213, reverse, complementary): 5'-ggggaccactttgtacaagaaagctgggtttgcttagtta gtggattgaagat-3'. PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombined in vivo with the pDONR201 plasmid to produce, according to the Gateway terminology, an “entry clone”. Plasmid pDONR201 was purchased from Invitrogen, as part of the Gateway® technology.

The entry clone comprising SEQ ID NO: 192 was subsequently used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A expression vector differing the GOS 2 promoter (SEQ ID NO: 245) for late embryo specific expression was located upstream of this Gateway cassette.

Figure 15:
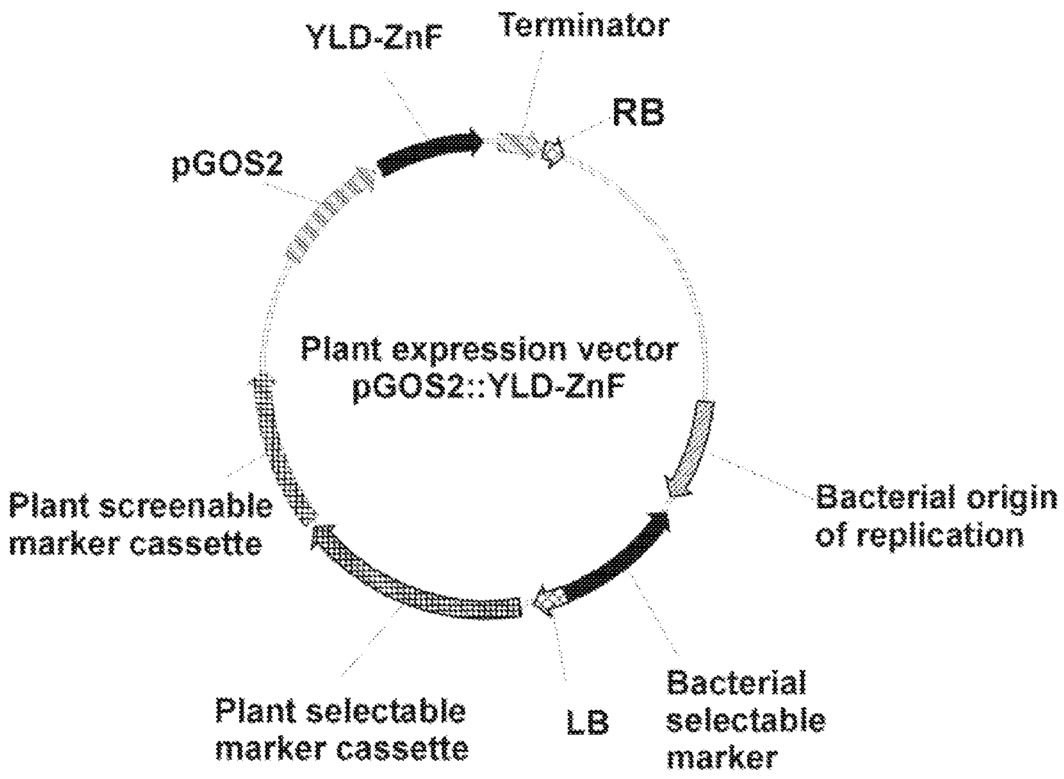
FIG. 15 shows the binary vector for increased expression in *Oryza sativa* of a nucleic acid sequence encoding a BIHD2 polypeptide under the control of the constitutive promoter GOS2 from rice.

After the LR recombination step, the resulting expression vector for constitutive expression (FIG. 15) were independently transformed into *Agrobacterium* strain LBA4044 according to methods well known in the art.

Example 10

Plant Transformation

Rice Transformation

The *Agrobacterium* containing the expression vector was used to transform *Oryza sativa* plants. Mature dry seeds of the rice *japonica* cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges1996, Chan et al. 1993, Hiei et al. 1994).

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188

(University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B4 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 11

Phenotypic Evaluation Procedure 11.1 Evaluation Setup

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants grown under non-stress conditions were watered at regular intervals to ensure that water and nutrients are not limiting to satisfy plant needs to complete growth and development.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Drought Screen

Plants from T2 seeds are grown in potting soil under normal conditions until they approach the heading stage. They are then transferred to a "dry" section where irrigation is withheld. Humidity probes are inserted in randomly chosen pots to monitor the soil water content (SWC). When SWC falls below certain thresholds, the plants are automatically re-watered continuously until a normal level is reached again. The plants are then re-transferred to normal conditions. The rest of the cultivation (plant maturation, seed harvest) is the same as for plants not grown under abiotic stress conditions. Growth and yield parameters are recorded as detailed for growth under normal conditions.

Nitrogen Use Efficiency Screen

Rice plants from T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

11.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

Because two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment—event—segregants). P values were obtained by comparing likelihood ratio test to chi square distributions.

11.3 Parameters Measured

Biomass-related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

Seed-related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 12

Results of the Phenotypic Evaluation of the Transgenic Plants 12.1 ODC Sequences The results of the evaluation of transgenic rice plants expressing a Nicta_ODC acid (SEQ ID NO: 1) nucleic under non-stress conditions as evaluated in T1 and T2 generation are presented below. An increase of at least 5% was observed for aboveground biomass (AreaMax), emergence vigour (early vigour or EmerVigor), total seed yield, number of filled seeds, and total number of seeds per (Table F1).

TABLE F1

| Parameter | % Increase in transgenic compared to control plant |
|---|---|
| AreaMax | 11 |
| EmerVigor | 30 |
| totalwgseeds | 12 |
| nrfilledseed | 11 |
| nrtotalseed | 14 |

Nitrogen Use Efficiency Screen

Rice plants from T2 seeds were grown in potting soil under normal conditions except for the nutrient solution. The pots were watered from transplantation to maturation with a specific nutrient solution containing reduced N nitrogen (N) content, usually between 7 to 8 times less. The rest of the cultivation (plant maturation, seed harvest) was the same as for plants not grown under abiotic stress. Growth and yield parameters were recorded as detailed for growth under normal conditions.

The results of the evaluation of transgenic rice plants expressing Chlre_ODC nucleic acid (SEQ ID NO: 62) under the conditions of the Nitrogen use efficiency are presented hereunder (Table F2). An increase was observed for total seed weight, number of filled seeds, fill rate, harvest index and thousand-kernel weight

TABLE F2

Evaluation of transgenic plants transformed with pChlre_ODC.

| Parameter | % increase in transgenic compared to control plant |
|---|---|
| AreaMax | 30.8 |
| EmerVigor | 33.4 |
| totalwgseeds | 23.66 |
| nrfilledseed | 24.7 |
| flowerperpan | 9.9 |
| harvestindex | 7.2 |
| firstpan | 14.77 |
| HeightMax | 13.5 |
| GNbfFlow | 9.3 |
| nrtotalseed | 24.9 |

13.2. BIHD1 Sequences

Under the Control of a Rice WSI18 Promoter

The results of the evaluation of T2 generation transgenic rice plants expressing a nucleic acid sequence encoding a BIHD1 polypeptide as represented by SEQ ID NO: 67, under the control of a WSI18 promoter for seed-specific expression, and grown under normal growth conditions, are presented below.

There was an increase in the early vigor, in the total seed yield per plant, in the number of filled seeds, in the total number of seeds, and in the harvest index of the transgenic plants compared to corresponding nullizygotes (controls), as shown in Table G.

TABLE G

Results of the evaluation of T2 generation transgenic rice plants expressing a nucleic acid sequence encoding a BIHD1 polypeptide as represented by SEQ ID NO: 67, under the control of a WSI18 promoter for seed-specific expression.

| Trait | Overall average % increase in 4 events in the T2 generation |
|---|---|
| Early vigor | 24% |
| Total seed yield per plant | 13% |
| Number of filled seeds | 14% |
| Total number of seeds | 13% |
| Harvest index | 8% |

Under the Control of a Rice RAB21 Promoter

Transgenic rice plants expressing a nucleic acid sequence encoding a BIHD1 polypeptide as represented by SEQ ID NO: 67, under the control of a rice RAB21 promoter for seed-specific expression, showed a positive tendency for the following yield-related traits: early vigor, total seed yield per plant, number of filled seeds, total number of seeds, and harvest index.

13.3. MYB30 Sequences

Plants from T2 seeds were grown in potting soil under normal conditions until they approached the heading stage. They were then transferred to a "dry" section where irrigation was withheld. Humidity probes were inserted in randomly chosen pots to monitor the soil water content (SWC). When SWC failed below certain thresholds, the plants were automatically re-watered continuously until a normal level was reached again. The plants were then re-transferred to normal conditions. The rest of the cultivation (plant maturation, seed harvest) was the same as for plants not grown under abiotic stress conditions. Growth and yield parameters were recorded as detailed for growth under normal conditions.

The results of the evaluation of transgenic rice plants expressing an MYB30 nucleic acid under drought-stress conditions described above are presented hereunder. An overall increase of more than 5% for aboveground biomass (AreaMax) and for emergence vigour (early vigour) was revealed (Table H).

TABLE H

| Results of the evaluation of transgenic rice plants expressing an MYB30 nucleic acid | |
|---|---|
| Parameter | % increase in the transgenics versus the nullizygous control |
| Emervigor | 19.9 |

13.4. THOM Sequences

The results of the evaluation of transgenic rice plants expressing a THOM nucleic acid under non-stress conditions are presented below. A significant increase was observed for total seed yield, number of filled seeds, harvest index, and Thousand Kernel Weight (Table I).

TABLE I

| Parameter | T1 plants Overall % increase | T2 plants Overall % increase |
|---|---|---|
| total seed yield | 20.3 | 39.7 |
| number of filled seeds | 16.9 | 30.4 |
| harvest index | 11.3 | 11.8 |
| Thousand Kernel Weight | 2.6 | 2.4 |

13.5. BIHD2 Polypeptides

Drought Screen

Plants from T2 seeds were grown in potting soil under normal conditions until they approached the heading stage.

They were then transferred to a “dry” section where irrigation was withheld. Humidity probes were inserted in randomly chosen pots to monitor the soil water content (SWC). When SWC failed below certain thresholds, the plants were automatically re-watered continuously until a normal level was reached again. The plants were then re-transferred to normal conditions. The rest of the cultivation (plant maturation, seed harvest) was the same as for plants not grown under abiotic stress conditions. Growth and yield parameters were recorded as detailed for growth under normal conditions.

Under the Control of the GOS2 Promoter

The results of the evaluation of T1 generation transgenic rice plants expressing a nucleic acid sequence encoding a BIHD2 polypeptide as represented by SEQ ID NO: 193, under the control of athe rice GOS2 promoter for constitutive expression, and grown under the drought screen conditions as detailed above are presented below (Table J).

TABLE J

| Yield trait | % increase in transgenic compared to control plants |
|---|---|
| TimetoFlower | 5.3 |
| totalwgseeds | 37.1 |
| fillrate | 54.9 |
| harvestindex | 49.0 |
| nrfilledseed | 31.1 |

SEQUENCE LISTING (252 sequences)

SEQ ID NO: 1 - DNA, 1852 bp, Nicotiana tabacum
ccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatctcgggccccaaataatgattttattttgactgatagtgacctgttcgttgcaacaaattgatgagcaatgcttttttataatgccaactttgtacaaaaaagcaggcttaaacaatggccggccaaacaatcatcgtttccgggttgaacccggcggccattcttcagtccacaattggcggcggagcttctcctacagcggcggcggcggcggaaaacggcaccagaaaagtcatccctctctcaagagatgccttacaagatttcatgttatcaatcataacccaaaaattacaagatgagaaacaacctttttacgtgctagacttgggtgaggttgtttctcttatggaccaatggaaatctgctctcccaaatatccgtccattttacgctgttaaatgtaaccctgaaccgtcgttcctttcaatttatctgctatgggctcaaattttgattgtgctagccgagctgaaattgagtatgttttatctcttggcatttcacctgaccgtattgttttcgcaaatccatgcaaaccggaatccgatattattttgcagcaaaagttggggtgaatcttacaacctatgattctgaagacgaggtttacaagatccgaaagcatcacccgaaatccgaactcttgctccgcatcaagcccatgctcgacggcaacgcgagatgcccaatgggcccgaaatacggcgcgcttccagaagaagtcgacccgctgctccgggcagctcaagccgcccgtctcaccgtatccggcgtctcattccacatcggtagcggagatgccgattcaaacgcttatctcggcgccatagccgcggctaaggaagtgtttgaaacagctgctaaactcgggatgtcgaaaatgactgttctagacgtcggcggcgggtttacatccggccaccagttcacaaccgccgccgtcgccgttaaatcagctttaaaacaacacttcgatgacgaaccggagttgacaatcatagctgaaccgggtcggttttttgcagagacggcgtttactttggcaacgacgattatagggaaaagagtgaggggtgaattgagggagtattggattaacgacgggctgtacggttcgatgaactgtgtactttacgaccatgcgacggtgaatgcaacgccgttagctgttctgtcgaatcgtagtaacgttacctgcggcgggtcgaaaacgtttccgacgactgtgtttgggcccacttgtgatgctcttgatactgttttaagggattaccagttaccggagctgcaggttaatgattggctggtttttcctaatatgggtgcttatactaaagctgctgggtccaattttaatggatttaatacttccgccattgttactcacctcgcttattctttccaagctgatgaaccacctgtaacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgt

SEQ ID NO: 2 - protein, 433 aa, Nicotiana tabacum
MAGQTIIVSGLNPAAILQSTIGGGASPTAAAAAENGTRKVIPLSRDALQDFMLSIITQKLQDEKQPFYVLDLGEVVSLMDQWKSALPNIRPFYAVKCNPEPSFLSILSAMGSNFDCASRAEIEYVLSLGISPDRIVFANPCKPESDIIFAAKVGVNLTTYDSEDEVYKIRKHHPKSELLLRIKPMLDGNARCPMGPKYGALPEEVDPLLRAAQAARLTVSGVSFHIGSGDADSNAYLGAIAAAKEVFETAAKLGMSKMTVLDVGGGFTSGHQFTTAAVAVKSALKQHFDDEPELTIIAEPGRFFAETAFTLATTIIGKRVRGELREYWINDGLYGSMNCVLYDHATVNATPLAVLSNRSNVTCGGSKTFPTTVFGPTCDALDTVLRDYQLPELQVNDWLVFPNMGAYTKAAGSNFNGFNTSAIVTHLAYSYPS

SEQ ID NO: 3 - DNA, 1698 bp, Aureococcus anophagefferens
atgctcgacgtcgcgtccaagttctcgcggagcggcgagtcgccgcgcgagtcgccgcggtcgtcgcggccccgctccgggtcgctgtcgacggtgcaggccgacgcctggcggacgcgcgacgagcggctgcgctgcatcgcggcgagctggacggcgcgcgtcgaggccgaggtcgcggcggtcgcggcgcgcggcggcggcggcgcgccgcgcatcgcgcgcggcgcgtggcccggcgactggccgagccgcgcggcgcggcccgcggcggcggcggcgtcgcgcgccgcggcggcggcggcgccgccggcgccgtcgccgcgcggtccgcccgaggcccgcgccgtgcccaacggccgcgcctgcggcctgcgggactactgcgcgtccgtcgtcgccgcggcgccgcgcgactacgcgggcccgttctacgtcgtcgacgtgggcgcggccgagcggctctacgacgcctgggcggcggcgctgccccgcgtgcggccccactacgccgtcaagtgcttccccgacgcgggcctctgccgcgcgctcgcggcgaagggctgcggcttcgactgcgcgtccgaggccgagtgtaggctcgtcttcgcgtgcggcgcgacgccgcgcgacgtcgtcttcgcgaacccctgcaagcggccgagcgacgtgaacttcctcgcggcgagcggcgtgccctggacgaccttcgactgctgcgacgagctcgcgaagctcgcggggctcctccccggcgcgacgcgggccgtgctccggctccgctgcgacgacccgacgagccgcctacccttcgggcccaagtacggcgccctcgaggacgaggtgcccggcctcctcgccgcggcgcgcgcggcgggcgtggccgtcgcgggcgtgtcgttccacgtcggcagcggcgcgcggtcgcccgcggcgttcgccgcggcgatcgcggccgcgcggcgcgccttcgacgccaacgccgcggcgggcggggctcccttcgacgtgctcgacatcggcggcggcttctgcggcggcttcgacgcgtcggggaccgcggccgtgtccgcgtcgggcgacgcgaccgtcgcggccgcggtcaacgccgcgctcgacctgagcttccccgcgtccgacttcccgggcctcgacgtcatcgccgagcccggccgctacttcgccgaggccgccgcgtcgctctgctgccgcgtcgtcggcgagcggcaccggtcgcgcgcggacgtcggcgcgccgccggagcccgaggcgcagtactggatcaccgacggcgtctacggcgccttcaacgccatcatctacgacggctggctgccccacgccgtcgtcgtcgacgacccgcggcgcgcacacggcgccggcgacgccggcggccgcggcgccggcgcggcgctcacgaccgtcttcggcccgacgtgcgactcgctcgacgtcgtcttctcgcgcgtccgaaacgcgccgccgctgcgccgcgacgactggctcctcttcccctgctgcggcgcctacacgagcgcgggcgcggccgacttcaacggcatccccgcgacggcggccgcgggcgtcgagacgaggtacgtccgctccgactccatgcgctgcacggccgacgacgacgccctcggcctcctctactccgacaagccgcccatggagatcatacgctactgcgactaa

SEQ ID NO: 4 - protein, 565 aa, Aureococcus anophagefferens
MLDVASKFSRSGESPRESPRSSRPRSGSLSTVQADAWRTRDERLRCIAASWTARVEAEVAAVAARGGGGAPRIARGAWPGDWPSRAARPAAAAASRAAAAAAPPAPSPRGPPEARAVPNGRACGLRDYCASVVAAAPRDYAGPFYVVDVGAAERLYDAWAAALPRVRPHYAVKCFPDAGLCRALAAKGCGFDCASEAECRLVFACGATPRDVVFANPCKRPSDVNFLAASGVPWTTFDCCDELAKLAGLLPGATRAVLRLRCDDPTSRLPFGPKYGALEDEVPGLLAAARAAGVAVAGVSFHVGSGARSPAAFAAAIAAARRAFDANAAAGGAPFDVLDIGGGFCGGFDASGTAAVSASGDATVAAAVNAALDLSFPASDFPGLDVIAEPGRYFAEAAASLCCRVVGERHRSRADVGAPPEPEAQYWITDGVYGAFNAIIYDGWLPHAVVVDDPRRAHGAGDAGGRGAGAALTTVFGPTCDSLDVVFSRVRNAPPLRRDDWLLFPCCGAYTSAGAADFNGIPATAAAGVETRYVRSDSMRCTADDDALGLLYSDKPPMEIIRYCD

SEQ ID NO: 5 - DNA, 1407 bp, Aquilegia formosa
aaaaaaaaaaaaggaaaaaaaaaagaaagaaaagggtttctcttcgcctcttctcttcatgggatccatagcaacaagttctaagagccttgaggccatattgaaagctcctggtgtgaagaacaaggaagtgattcggctttcaaatgggaaatcaactgattttattcagtctttcatctcaccgaatcaagaggtaagagaccctttctatgtattggacttgggtatggttagtagtctaatggatcaatggaacagtagcatacccagtattcggcctttttacgctgttaaatgtaatcatgagcccaccttacttgctgccttagcagcacttggggtgggatttgattgcgctagtcaggccgaaatggaggctgttttggcactaggggtgtctgcagaccaaatagtttttgccaatccatgcaaggctgagactcatattaagtttgcagctagtgtaggagtcaatctgactacttatgattcaccatatgaaattgagaaaatgaaaaaatggcaccctaaatgtgcccttttgttgcgtataaaggctggagatgatggaaatgctagatgccctttaggacctaagtatggtgcattgcctgaagaggtcacacaacttcttcaggctgcccacgctgctggacttcctgtagttggagtgtcatttcatgtgggcagcgcaaccacgtactcactagcatatcgcagtgccatagcagctgcaaaggaagttttcaacactgcgttgcaacttggtatgccaaggatgaggactttaaacattggcggtgggttctttgcaggaccccatttcgaagaggctgctgtcacaatcaaagatgctctgcaattgtactttgggaatgaaactgatttagaagtagtctctgaaccgggtcggttctttgccgaaacagcattcacattggcaacatgcattattggaaagcgtgtgcgtggcgagctaagggaatactggattaatgatgggctatatggttctatgaattgtatgctgtatgatcatgcaactgtgactgcaacaccactagcctgcacatcggatcctaccaacccgaaatgcaatggggtaaaaacatatccatcgacagtgttcggacccacttgtgatgctcttgatacaattctcactgattaccagctacctgatcttcaggtaaacgattggcttgtgttcccaaatatgggtgcttatactgcttgtgctggatccaagtttaatgggtttgatacctcagctatacctacttacctggcttgttcggatccatgcattggtcaagagaacaattgataggttggctatcatattttgttttgtttttatttattattgcagttttatctttcgaaactttttaataggaaatt

SEQ ID NO: 6 - protein, 423 aa, Aquilegia formosa
MGSIATSSKSLEAILKAPGVKNKEVIRLSNGKSTDFIQSFISPNQEVRDPFYVLDLGMVSSLMDQWNSSIPSIRPFYAVKCNHEPTLLAALAALGVGFDCASQAEMEAVLALGVSADQIVFANPCKAETHIKFAASVGVNLTTYDSPYEIEKMKKWHPKCALLLRIKAGDDGNARCPLGPKYGALPEEVTQLLQAAHAAGLPVVGVSFHVGSATTYSLAYRSAIAAAKEVFNTALQLGMPRMRTLNIGGGFFAGPHFEEAAVTIKDALQLYFGNETDLEVVSEPGRFFAETAFTLATCIIGKRVRGELREYWINDGLYGSMNCMLYDHATVTATPLACTSDPTNPKCNGVKTYPSTVFGPTCDALDTILTDYQLPDLQVNDWLVFPNMGAYTACAGSKFNGFDTSAIPTYLACSDPCIGQENN

SEQ ID NO: 7 - DNA, 1430 bp, Capsicum annuum
ttgaattcttattttctctgtttccctttgagtcctccgaatggccggccaaacagttattgtttccgggttaaacccggcggccattcttcagtcaacaatcggcggagctcctccttctaccgccgcagctgcggcggagaacggtgacaccaccagaaaagttgttcctctatcaaaagatgcccttcaggatttcatggtttccatcataacccagaagttacaaggtaaaaagaagccgttttatgtgttagatttgggggaagttgtttccctgatggatcaatggaacgttgcgttgccgaatgttcatccgttttatgctgtgaagtgtaatcctgaaccttcattcctttctatgttggctgctatgggttcgaattttgattgtgctagccgtgctgaaattgagtacgttttgtctcttggtatctcgccggagaggattgtattcgctaacccatgtaagccggaatccgatatcattttcgccgaaaaagttggagtcaatctcacaacttacgattcagaggacgaggtttacaagatcaaaaagcatcacccaaaatgcgagcttttgctccgtatcaaaccgatgaacgatggtaatgctagatgtccaatgggtccaaaatacggcgctttgcctgaagaaatcgagccgcttctccgtatagctcaagcttcccggctcactgtctccggcgtctccttccatatcggcagcggcgacgctgattccaacgcttatttaggcgccatagccgcagccaagcaagttttcgaaacggcagccaaattcggcatgtcgaaaatgaatgttctagacatcggcggcgggtttacctccggccaccagttcaccaccgcagcaaccgccgtgaaatcagctttacaacaacacttctctaacgaaccggagctcaccatcatagctgaaccgggtcggtttttcgcagaaacggcgttcacattggcaacaaccatcatcggaaaaagagtacgtggagatttacgtgaatactggatcaacgacgggttatacgggtcaatgaactgtgtactttacgatcatgcaacggtaacggcgacgccgttggcatgcatgtcgaatcgggtcaacctaaactgcagcgggtcgaaaatgtttccgtcgactatattcgggcccacgtgtgatgcacttgataccgtgttaagggattaccagttaccggaactgcaggttaatgactggttaatttttcctaatatgggtgcttatactaaagctgctggatcaaattttaatggatttaatacttctgccattgttactcaccttgcttatgcttatccaagttgataggatttaattagcaaggggttgtaattttatttttcttatgggtttccaattttgtgtttgtaaaaaaaaaaaaaaaaaa

SEQ ID NO: 8 - protein, 435 aa, Capsicum annuum
MAGQTVIVSGLNPAAILQSTIGGAPPSTAAAAAENGDTTRKVVPLSKDALQDFMVSIITQKLQGKKKPFYVLDLGEVVSLMDQWNVALPNVHPFYAVKCNPEPSFLSMLAAMGSNFDCASRAEIEYVLSLGISPERIVFANPCKPESDIIFAEKVGVNLTTYDSEDEVYKIKKHHPKCELLLRIKPMNDGNARCPMGPKYGALPEEIEPLLRIAQASRLTVSGVSFHIGSGDADSNAYLGAIAAAKQVFETAAKFGMSKMNVLDIGGGFTSGHQFTTAATAVKSALQQHFSNEPELTIIAEPGRFFAETAFTLATTIIGKRVRGDLREYWINDGLYGSMNCVLYDHATVTATPLACMSNRVNLNCSGSKMFPSTIFGPTCDALDTVLRDYQLPELQVNDWLIFPNMGAYTKAAGSNFNGFNTSAIVTHLAYAYPS

SEQ ID NO: 9 - DNA, 2126 bp, Chlamydomonas reinhardtii
gtatcctccttattgacacccaaacgctacaaagtcactgaatttcacactgaaagctctccagaaagcgcaaggacttcagtttcaatctaactttcccctttcgttgctcccagccacatacgataggggcttagggtcgtattagctcatcacggacatcgccatgactggcgctaaggatgtcgtcacgctggttccgggcgcgacgcatgctggtgcaggagaggcccctttcgttagaactagcttccaaaacgatatgcgcacgagctttggccgctcctccgccaccgacggccccatgaaggtggatgcggcggtgccgcctgcgcttgcagccgcggtgcagccaattgatcgcggccccgcagctgccgccagctcgctgggccccgccgcctcgcaggagctgtcccgcgccatgctgtccagctggcagtaccgcgtgtccggcaaggcggcggtggcggagctgctgcaggagtgcgccgccgagcacattgcctgcggcgggcctcgcggcgtggaggaggtggcggtgcgccacatccggcgccacgacattgactcggattccatctacgtcgtagacctggcatcgcccttccgcctgttcaaggcctggcgcgccgccatgccgcgtgtgctgccctactacgctgtcaagtgctaccccgagcccgctatcctcaagctgctcatggcgctgggcgccggcttcgactgcgccagcaagggcgagctggacatgatgctcaagctgggggtgtcgcccggccgcatcatcttcgcgcacccctgcaagcgcggcgccgacttccgctacgcgcgcgagcacggcatcacttacaccacctttgacagcagctccgagctgcacaagattgcggagatggacccggagttcaagtgcgtgctgcgcatccgcgcggacgaccccggggcgcgtgtgccgctgggcctcaagtacggcgctgaggtggaggaggcggcggggctgctggcggaggccaagcagctggggctggaggtggtgggcgtgtcgttccacgtgggcagcgccgccaagaacctggccaccttcacaaacgccatcgccaacgcgcgcaaggtgtttgacgacgccgccggcatgggcttcaagatggagctgctggacattggcggcggcttcaccggccacttcgacgagtgcggcaacgtcatgtttggcgagatcgccaacaccatcaacgccgcactcgccacctacttcccgccgggcggcgatctgggcgacgtgcgcgtcatcgccgagccgggccgctacttcgccgagaccagcagcaccctcatgacggtggtgatcgggcagcgcgaccggccgcagaaggacggctccacgcacaaagactactggctcacggacggactgtacggcagcttcaactgcatcgtgtacgacggccagaacccggagtggcgcatcgtgcggtcgcccatcctgcccgaccccgccgacgccaagaccacctacgtgtccacgttgtggggccccacctgcgactccgccgacgtggtgtacaaggacgtggcgctgccggagctgcgcaacggcgactggctgctgtggcccaacgccggcgcctacacggtggcgggcgcatgcgacttcaacggcatcgagttcaccacacccatgaaggtgtatgtgtggagcgacatcgcggtggacgtcgaggtgccggaggcggacagcaaggccgagcaggccgcggagggggcccagtagtaggtgcgcggcgcgtgagcgagtacttgcttttgtatgtgtgggtgcgagggggtgaacaaacagaggtattatttgctatcgctattcaggcgggcgccaagtatttgcatcacaggttccgccctgcgttagacccgaccaggatggtggccgtgcacgttccgagcggtgcctgtgctccttactccttagagcgccatgccgccgtggtgcgaaatgaaggaagcacgcgcgagtatacatatgcggccatggtccgcccagccctgcgtgcgtgctaacggcacggccgtggtcagggaaggtctcggtcttctgtttcatgctttggtgatggacttcgtcggat

SEQ ID NO: 10 - protein, 535 aa, Chlamydomonas reinhardtii
MTGAKDVVTLVPGATHAGAGEAPFVRTSFQNDMRTSFGRSSATDGPMKVDAAVPPALAAAVQPIDRGPAAAASSLGPAASQELSRAMLSSWQYRVSGKAAVAELLQECAAEHIACGGPRGVEEVAVRHIRRHDIDSDSIYVVDLASPFRLFKAWRAAMPRVLPYYAVKCYPEPAILKLLMALGAGFDCASKGELDMMLKLGVSPGRIIFAHPCKRGADFRYAREHGITYTTFDSSSELHKIAEMDPEFKCVLRIRADDPGARVPLGLKYGAEVEEAAGLLAEAKQLGLEVVGVSFHVGSAAKNLATFTNAIANARKVFDDAAGMGFKMELLDIGGGFTGHFDECGNVMFGEIANTINAALATYFPPGGDLGDVRVIAEPGRYFAETSSTLMTVVIGQRDRPQKDGSTHKDYWLTDGLYGSFNCIVYDGQNPEWRIVRSPILPDPADAKTTYVSTLWGPTCDSADVVYKDVALPELRNGDWLLWPNAGAYTVAGACDFNGIEFTTPMKVYVWSDIAVDVEVPEADSKAEQAAEGAQ

SEQ ID NO: 11 - DNA, 2385 bp, Chlamydomonas reinhardtii
gcctgcctgaccttgcagccacctcggcttcggtactctcgctttacttcccagctcgagctatcgctctcgcctagcgttcacgctggcgccccgcaatctcgcaaccgctcttttagcgcgcagctctactatcctgtgcagcctaggctctcaggctatcatcccaaggtctactccagtcgttcggtccaaccgcgtcatcatgacaacttccgaggttctgagtcccccgcccccgagccaggtggctagcctggctcagccgcagttcaacgtggaggcgcttcaggccttctcgatgcccctggtggccgacgttgtcaacactgaaaatggcgacgtcgcttcgttcgcccgcagctcctggcacaaggagtcgggcaaggcgggggcgttcggcctgccgaccatgctggatatgaaggctgaggctctggagcaggtgcagctggacacctggtcggcgcagcctgtggaccgtggtccggcagcagcggctcctgaccccaagctgctgcgctcctggcagtaccaggctactggcaagcttgcaaccgctcaggtcctggtggacgtcaaggctgagcacatcaaggctggtggccccatgggcatgaagcaggaggccattaagcacatcctgcgccacaagccggacgacaccttctatgtggttgacctggctaacgtgcagcgcatgttcaaggcctggcgcgccgctatgccccgcgtggtccccttctacgcggtcaagtgcaacccggagccgggtatcctgaagctgctgaacgcgctgggtgctggcttcgactgcgctagcaagggcgagctggacatgatgctgcgcatgggcgtctcgcccaaccgcattatctttgctcacccctgcaagcgcgcctcggacatccgctacgcgcgcgagcacaacgtgcagtacaccacgttcgacaccgtgtcggagctgcacaagatcgcgcagatgaaccccgacttcaagtgcgtgctgcgcatccgcgccgacgacccggacgcccgcgtgcctctgggcctgaagtacggcgctgaggtgtcggaggccgacgtgctgctgcgcacggcgaaggagctgggcctgcaggtggtgggcgtcagcttccacgttggcagcgcttgccagaacctgtccaccttctcgggcgccattgagaacgcgcgcaaggtgttcgacgaggccggcgccctgggcttcaacatggagctgctggatatcggcggtggcttcaccggccacttcgacgagatgggcaacgtgatgttcggcgagatcgcgaacaccatcaacgccgctctggccaccaacttcccgccggagatgggcgtgcgcgtcatcgccgagcccggccgctacttcgctgagaccagcagcacgctgctgacccccgtctacggccagcgcgaccgcgtggctgccgacggctccgtgaagaaggactactggctcaccgacggcctgtacggctccttcaactgcattctgtacgacggccagaaccctggctacaaggtcgtgcgctcgccgctgatggccgactcgaccgacagccgcaccttcctgtcgaccctgtggggtcccacctgcgacagcgctgactgcgtctacaaggacgtgaccctgcccgtgctgcgcaacggtgactggctgatgtggaacaacgccggcgcctacaccgtggccggtgcctgcgacttcaacggcatcgagttcaccactccgggcaagctgtacgtgtggtccgacagcgcggtggacgcggccgaggagggcgctgacgagcaggtcatgaacgcgtgaacgcaacgtgacagcacttcgcgattgctctcgtgatatttgcgcgcgggatgacccgctctgtctgcatttctgtttattggatggtttgttgtccgcccttgaatgagggccacgatgggcacgggggcgtggtgtcagatgtggtccggccacagcttgggcgtgtgaaagtctcaggttgggttttgttcatagtcgccgggcacgcctgaccggccccgctgctaaaattgccacaggactagcaaactgcattatgaagtttttgggacggaatttgtcactatacttgtatttctggccccgcgagatgcacgggtgtcagtcgaggaggggcagaccgcctccgccggagaaagatgtacagggtacgcagggtgtatgcaggttagacatgcagatggaccggtcgattttggatgaggaggattgcagcacggactggatgcgattggacctggaacgtgtaacgaaagaacgatgatgcattggtcccgtccagtggggacgtggatgctgtctagtcaggattttgaccatcaggatta

SEQ ID NO: 12 - protein, 542 aa, Chlamydomonas reinhardtii
MTTSEVLSPPPPSQVASLAQPQFNVEALQAFSMPLVADVVNTENGDVASFARSSWHKESGKAGAFGLPTMLDMKAEALEQVQLDTWSAQPVDRGPAAAAPDPKLLRSWQYQATGKLATAQVLVDVKAEHIKAGGPMGMKQEAIKHILRHKPDDTFYVVDLANVQRMFKAWRAAMPRVVPFYAVKCNPEPGILKLLNALGAGFDCASKGELDMMLRMGVSPNRIIFAHPCKRASDIRYAREHNVQYTTFDTVSELHKIAQMNPDFKCVLRIRADDPDARVPLGLKYGAEVSEADVLLRTAKELGLQVVGVSFHVGSACQNLSTFSGAIENARKVFDEAGALGFNMELLDIGGGFTGHFDEMGNVMFGEIANTINAALATNFPPEMGVRVIAEPGRYFAETSSTLLTPVYGQRDRVAADGSVKKDYWLTDGLYGSFNCILYDGQNPGYKVVRSPLMADSTDSRTFLSTLWGPTCDSADCVYKDVTLPVLRNGDWLMWNNAGAYTVAGACDFNGIEFTTPGKLYVWSDSAVDAAEEGADEQVMNA

SEQ ID NO: 13 - DNA, 1577 bp, Datura stramonium
aacactcaatattcatatatacatatatatttgaatccctaatttctttgttttcctttgattcctcctctctttggatggccggccagacagtcatcgtttccgggttgaacccggcggccatccttcagtccacaatcggcggagctactcctgcaccggcggcggagaacgaccacaccagaaaagttgttcccctctcaagagatgcccttcaggatttcatggtttcaatcatcacccagaaattacaagatgaaaagcagcccttttatgtgctggatttgggagaagttgtctcccttatggatcaatggaacgccggtttaccaaatatccgtccattttatgctgttaagtgtaacccagaaccttcatttctgtccatgttgtctgctatgggttccaattttgattgtgctagccgtgctgaaattgagtatgttttgtcactcggtatctcaccggaccgtatcgttttcgccaacccatgtaagccggaatccgacataattttcgccgcaaaagttggggttaatctcacgaccttcgattccgaggacgaggtttacaagatccgtaagcatcacccgaaatgcgagctgttgctccgaatcaaacccatggacgacggcaatgcaagatgccctatgggacctaaatacggggcactgcctgaagaagtcgagcccctgctccggaccgctcaagccgccaggctaaccgtctctggcgtttccttccacatcggcagcggagacgccgattccaaagcttatttaggagccatagctgcggcgaagggagttttcgaaacagcggctcggttcggtatgtccaaaatgacggtgttagacatcggcggtggatttacctccggccaccaattcaccaccgcctccgccgctgtcagatcagccctggagcaacacttccatgacgaacaagagctaacaatcatcgccgaaccgggtcggttctttgcagagacggcgttcactttagccacaaccattatcggaaaaagagtgaggggagaattaagagaatactggatcaacgacggcttgtacggatcgatgaactgtgtactttacgaccacgcgacggtgaacgcgacgccgttagcgtgcatgtcgaatcgtagtaacctcaactgcggcgggtcgaaaacgtttccgtcgactgtattcgggcccacctgtgatgcacttgatactgtgttaagggattaccagttaccggagctacaggttaatgactggctgatttttcctaatatgggtgcttacacaaaggctgctgggtccaacttcaatggattcaacacatccgccattgttactcaccttgcttatgcttatcctagctgataaaatcaccaccaattagaatctaattagcagcgtggttgtaattttttccttttttgggggtttttttctaatttgtttccttttttttgtaatttatttttccagtcagctgtagtagtcctcctgtgtctcataagaaaagcaaggatttgctaattggatttcgctcttaattagaagtcatttaattaaaaaaaaaaa

SEQ ID NO: 14 - protein, 431 aa, Datura stramonium
MAGQTVIVSGLNPAAILQSTIGGATPAPAAENDHTRKVVPLSRDALQDFMVSIITQKLQDEKQPFYVLDLGEVVSLMDQWNAGLPNIRPFYAVKCNPEPSFLSMLSAMGSNFDCASRAEIEYVLSLGISPDRIVFANPCKPESDIIFAAKVGVNLTTFDSEDEVYKIRKHHPKCELLLRIKPMDDGNARCPMGPKYGALPEEVEPLLRTAQAARLTVSGVSFHIGSGDADSKAYLGAIAAAKGVFETAARFGMSKMTVLDIGGGFTSGHQFTTASAAVRSALEQHFHDEQELTIIAEPGRFFAETAFTLATTIIGKRVRGELREYWINDGLYGSMNCVLYDHATVNATPLACMSNRSNLNCGGSKTFPSTVFGPTCDALDTVLRDYQLPELQVNDWLIFPNMGAYTKAAGSNFNGFNTSAIVTHLAYAYPS

SEQ ID NO: 15 - DNA, 1628 bp, Glycine max
gctggagctccccgcggtggcggccgctctagaactagtggatcccccgggctgcaggcaaaaatgccttcactagttgctgaagcattccaagccaatggcgcagaacccttgaacctgaagcccattttctgtgcctcaggcatcaagggcaagcgagtgactgcgttgtcagcagaaaaaaatggcctcactgatttcattcaaagaatcattgctgacaaaccagacatcgacacaccattcagcgtcctcgatttgggggtcgtcatgggcctgatggaccaatgggcctgcaagctccccacggtccagcccttctacgccgtcaagtgcaacccaaacctctccctcatcggtgcgctcgctgcgctcggctccagcttcgactgcgccagcaaagccgagatcgaatccgttctctccctcggagtctcacccgacagaatcatctatgcaaacccatgcaaatccgagtcacacatcagatacgccgcctccgtaggcgtcaacgtcacaacctacgactccatagacgaggtcgagaaaatccgaaaatgccaccccacgtgcgagttgctcctccgcattaaacccccgcaagacagcggagcgcgaaccagcttgggcctcaaatacggcgcgcttcccgaggaagtcgatgagcttctccaagctgctcacgaggcggggctcaaggtgaccggcgtgtccttccacattggtagcggcggagccgacacgcgagcctaccacggagccatatccgccgctaaaaacgtcttcgaatcggcttctcggctcggcttgcccagaatgggcgtcctcgacatcggcggcggcttcacctctgggccgtcgttcgaagccgcggctttgaaaataaacgccgcgattgaaggcagcttcgggaaggaggaggggctggtggtgattggcgagccgggtcgttatttcgcggaaacggctttcacgttggcgacgagagttattggaaagcgcgtcaggggggacgtgagggagtattggattgacgatgggatttacggaactcttaataacatcgtgtttgattacgctaccgtcacgtgcatgccactcgcgtgcacctcgaaaccggagaatcctacatgctgcagggatttgaatttgaagacttaccctagcaccgtgtttggacccacatgcgattctattgatacggttctgagggattaccagctcccggaactgcaagtgaacgattggcttgtgttcccgaacatgggtgcctatacgacgtcgtccgggactaacttcaatgggtttagctcctcagccaagtccatattccttgcatgttcgagcccggaacacaccatgttctaatcaatacaaatcccaaactatcccttgctcaatgtacttacttattttattatcaacttgtctctcttttggtttcggaaactcaataatggcggaatggctgctcgtggacgccgcgtggtttctctcttgattgtattactactatctttttcttttcatttatattttctaatttggagacacctacgtaccttttgatattcgaaataaaatttcgtttattgttgatactaaaaaaaaaaaaaaaaaaaaaaaaa

SEQ ID NO: 16 - protein, 434 aa, Glycine max
MPSLVAEAFQANGAEPLNLKPIFCASGIKGKRVTALSAEKNGLTDFIQRIIADKPDIDTPFSVLDLGVVMGLMDQWACKLPTVQPFYAVKCNPNLSLIGALAALGSSFDCASKAEIESVLSLGVSPDRIIYANPCKSESHIRYAASVGVNVTTYDSIDEVEKIRKCHPTCELLLRIKPPQDSGARTSLGLKYGALPEEVDELLQAAHEAGLKVTGVSFHIGSGGADTRAYHGAISAAKNVFESASRLGLPRMGVLDIGGGFTSGPSFEAAALKINAAIEGSFGKEEGLVVIGEPGRYFAETAFTLATRVIGKRVRGDVREYWIDDGIYGTLNNIVFDYATVTCMPLACTSKPENPTCCRDLNLKTYPSTVFGPTCDSIDTVLRDYQLPELQVNDWLVFPNMGAYTTSSGTNFNGFSSSAKSIFLACSSPEHTMF

SEQ ID NO: 17 - DNA, 1588 bp, Glycine max
ctctcgtctaccaattaaaaatgccttcactagttgcggaggcattcgaagccaagggcgcagaacccttgagcctgaagcccattttcagtgcctcaggcgtcaagggcaagcgagtaactgcactatcagcagaagcaaatgccctcactgatttcattcaagcaatcatagctgacaaaccagacatcgactctccattcagcgtcctcgatttgggcgtcgtaatgggcctcatggacaaatgggcctgcaagctccccacggtccagcccttctacgccgtcaagtgcaacccaaacctctccctcatcggcgcgctcgctgcactcggctccagcttcgactgcgccagcaaagccgagatcgaatctgtcttgtccctcggagtctcaccggacagaatcatctacgcaaacccatgcaaatccgagtcccacatcagatacgccgcctccgtaggtgtcaacgtcacaacctacgactccctcgacgaggtcgagaaaatccgcaattgccaccccacgtgcgagttgctcctccgcattaaacccccgcaagacagtggagcgcgtaccagcttgggcctcaaatacggcgcgcttcccgaggaggtccatgagcttctccaagctgctcacgaggcggggctcaaggtaacaggcgtgtccttccacattggtagcggcggagccgacacgcgagcctacgacggagccatatccgccgctaaaaacgtattcgaaatggcttctgggctcggcttgcccagaatgcgcgttctggacatcggaggcggcttcacctctgggccgccgtttgaagccgcggcattgaaaataaacgctgcgattcaggccagcttcgggaacgaggaagggctcgtggttattggcgaaccgggtcgttacttcgctgaaacggctttcacgttggcgacgagaattattgggaagcgcgtgaggggggacgtgagggagtactggattgacgatgggatttacggaacgcttaataacatagtgtttgattacgctaccgtcacgtgcatgccactggcgtgcacctcgaaaccggagaatcctagatgcagcagggaattgaatttgaagacttaccctagcaccgtgtttggacccacgtgcgattctattgatacggttctgagggattacaagctgccgggactgcaagtgaacgattggctagtgttcccgaacatgggtgcatatacgacgtcgtcggggactaacttcaatgggtttagctcctcagccaagtccacgttccttgcatattccagcccggaacacagcatgttctaatcaatgcaagtcccaaaccgatataccttggtatttgctgaatgtactttagttattattattaacttatctctcttttggtttgggatactcaataatggcggaatgggtgctcgtgtacgccgcgtggtttctctcttctgattgtactttctttttctttccatttatgctagtgttttctaatttcgagacacctaccttttgatattcgaaataaaattttgtttattgttggtaaaaaaaaaaaaaaaaaaaaaaaa

SEQ ID NO: 18 - protein, 434 aa, Glycine max
MPSLVAEAFEAKGAEPLSLKPIFSASGVKGKRVTALSAEANALTDFIQAIIADKPDIDSPFSVLDLGVVMGLMDKWACKLPTVQPFYAVKCNPNLSLIGALAALGSSFDCASKAEIESVLSLGVSPDRIIYANPCKSESHIRYAASVGVNVTTYDSLDEVEKIRNCHPTCELLLRIKPPQDSGARTSLGLKYGALPEEVHELLQAAHEAGLKVTGVSFHIGSGGADTRAYDGAISAAKNVFEMASGLGLPRMRVLDIGGGFTSGPPFEAAALKINAAIQASFGNEEGLVVIGEPGRYFAETAFTLATRIIGKRVRGDVREYWIDDGIYGTLNNIVFDYATVTCMPLACTSKPENPRCSRELNLKTYPSTVFGPTCDSIDTVLRDYKLPGLQVNDWLVFPNMGAYTTSSGTNFNGFSSSAKSTFLAYSSPEHSMF

SEQ ID NO: 19 - DNA, 1586 bp, Lotus japonicus
gaaatactccttttgttttctttcacctagctatacctacctatctagtactaagagaagccaaacaatgccttcactagtctccggggaaatccaagccaaagatgctgccgagtctctaagcctgaacccaatttttagtgcctcaggagtgaagggaaagcgagttaccgcattgaccaaagaatgtgacatgtctcatctcattgaatccatcattgctgacaaaccagacatggattcttcattcagcgtgcttgatcttggggtagtcatggaactcatggacaagtgggtcaccaagttccccaccgttcagcctttctacgccgtcaagtgcaaccccgacatctccctcatcggcgccctcgccgcactaggctccagcttcgactgcgccagcaaagctgagatccaaatcgtcttgtccctcggcatctcaccggaccgcattgtctacgccaacccgtgcaaatccgagtccgacatcaagtatgccgcaaccgtcggcgtcaacctcgcaacctatgactccgtgtacgaggttgacaaggtacaaaagtggcacccgaaatgcgagttgctcctccgcataaagtatgacagtgaaggagcattggcatcgctcggcgtcaaatacggcgcgctccctgaggaagtcccggagcttctcaaagccgctgaggcggcaggcgtaaatgtgactggcgtgtcgttccacattggcagcgggggagccgacccgctagccctctccggagctatcgaagccgccaagagcgtctttgagatggcaagccatttcggaatgtccaggatgtctatcctcgacatcgggggtgggttcacctgcggaccagagctggacgttgcggccacgaaggtgaaggctgcaattctagcccacttcggagaccaccagggtctcgtggttatcgcagagcctggtcgttacttcacggaaacggcgttcacgttagttagcagggttattgggaaacgagttaggggagagttgagggagtattggatcaatgatggagtttatggatctatcagtaacataatatatgaccacgctaccattaggtgcgcaccactaaggcaaaagaatctcacgtgcgtggatgcgaagacctaccctaccaccgtgttcggacccacatgcgattgcattgacattgttctcaaggattaccagctaccagaactgcaggtgaatgattggcttgtgttcccgaatatgggagcttatactatttcttcagggactaacttcaatgggtttacttcagcagtcaaacatgtctatctcgcatgttctgaacaatcctaaactaatgatgttgtgaaaccaaaataataatggcactggtggtcttgtaactttagtgatctctcttctatgtatgttttgtattgtattcaattgaattcaactacacattgaattcaatggagtaagctttggtgtcttgatgtatattttccgtttgccttgttacaaacgggaaatcaaacacctatatgataagaaataaaattttgttttagtgttttaaaaaaaaaaaaaaaaaaaaaaaaaa

SEQ ID NO: 20 - protein, 422 aa, Lotus japonicus
MPSLVSGEIQAKDAAESLSLNPIFSASGVKGKRVTALTKECDMSHLIESIIADKPDMDSSFSVLDLGVVMELMDKWVTKFPTVQPFYAVKCNPDISLIGALAALGSSFDCASKAEIQIVLSLGISPDRIVYANPCKSESDIKYAATVGVNLATYDSVYEVDKVQKWHPKCELLLRIKYDSEGALASLGVKYGALPEEVPELLKAAEAAGVNVTGVSFHIGSGGADPLALSGAIEAAKSVFEMASHFGMSRMSILDIGGGFTCGPELDVAATKVKAAILAHFGDHQGLVVIAEPGRYFTETAFTLVSRVIGKRVRGELREYWINDGVYGSISNIIYDHATIRCAPLRQKNLTCVDAKTYPTTVFGPTCDCIDIVLKDYQLPELQVNDWLVFPNMGAYTISSGTNFNGFTSAVKHVYLACSEQS

SEQ ID NO: 21 - DNA, 1302 bp, Nicotiana benthamiana
atggccggccaaacaatcatcgtttccgggttgaacccggcggccattcttcagtccacaattggcggcggagctttccctacagcggcggcggcggcggaaaatggcaccagaaaagtcatccctctctcaagagatgccctacaagatttcatgttatcaatcataacccaaaaattacaagatgagaaacaacctttttacgtgttagatttgggtgaggttgtttctcttatggaccaatggaaatctgctctcccaaatatccgtccattttacgctgttaagtgtaaccctgaaccgtcgttcctttcaattttatctgctatgggctcaaattttgattgtgctagccgtgctgaaattgagtatgttttatctcttggaatttcacctgaccgtattgttttcgcaaatccatgcaaaccggaatccgatattatttttgcagcaaaagttggggtgaatcttacaacctatgattcagaagacgaggtttacaagatccgaaagcatcacccgaaatccgaactcttgctccgaatcaagcccatgctcgacggcaacgcgagatgcccaatgggcccgaaatacggcgcgcttccagaagaagtcgacccgctgctccgggcagctcaaaccgcccgtctcaccgtctccggtgtctcattccacatcggtagcggagatgccgattcaaacgcttatctcggcgccatagccgcggctaaggaagtgtttgaaacagctgctaaactcgggatgtcgaaaatgactgttctagacgtcggcggcgggtttacatccggccaccagttcacaaccgccgccgtcgccgttaaatcagctttaaaacaacacttcgatgacgaaccgggattggcaatcatagctgaaccgggtcggttttttgcagagacggcgtttactttggcaacgacgattatagggaaaagagtgaggggtgaattgagggagtattggattaacgacgggctgtacggttcgatgaactgtgtactatacgaccatgcgacggtgaatgcaacgccgttagctgttctgtcgaatcgtagtaacgtcacctgcggcaggtcgaaaacgtttccgacgactgtgtttgggcccacttgtgatgctcttgatactgttttaagggattaccagttaccggagctgcaggttaatgattggctggtttttcctaatatgggtgcttatactaaagctgctgggtccaattttaatggatttaatacttccgccattgttactcacctcgcttattcttatccaagctga

SEQ ID NO: 22 - protein, 433 aa, Nicotiana benthamiana
MAGQTIIVSGLNPAAILQSTIGGGAFPTAAAAAENGTRKVIPLSRDALQDFMLSIITQKLQDEKQPFYVLDLGEVVSLMDQWKSALPNIRPFYAVKCNPEPSFLSILSAMGSNFDCASRAEIEYVLSLGISPDRIVFANPCKPESDIIFAAKVGVNLTTYDSEDEVYKIRKHHPKSELLLRIKPMLDGNARCPMGPKYGALPEEVDPLLRAAQTARLTVSGVSFHIGSGDADSNAYLGAIAAAKEVFETAAKLGMSKMTVLDVGGGFTSGHQFTTAAVAVKSALKQHFDDEPGLAIIAEPGRFFAETAFTLATTIIGKRVRGELREYWINDGLYGSMNCVLYDHATVNATPLAVLSNRSNVTCGRSKTFPTTVFGPTCDALDTVLRDYQLPELQVNDWLVFPNMGAYTKAAGSNFNGFNTSAIVTHLAYSYPS

SEQ ID NO: 23 - DNA, 1299 bp, Nicotiana glutinosa
atggccggccaaacaataatcgtttccgggttgaacccggcggccattcttcagtccacaataggcggcggagcttcacctacagcggcggcggcggaaaacggcaccagaaaagtcattcctctctcaagagatgctctccaagatttcatgttatcaatcataacccaaaaattacaagatgagaaacaacctttttacgtgttagatttgggtgaagttgtttctcttatggaccaatggaaatcttctctcccaaatatccgtccattttacgctgttaaatgtaaccctgaaccgtcgttcctttcaattttatctgctatgggctcaaattttgattgtgctagccgagctgaaattgagtacgttttagcccttggcatttcgcctgaccgtattgtttttgcaaatccatgcaagccggaatccgatattatttttgcagcaaaagttggggtgaatttaacaacgtacgattcagaagacgaggtttacaagatccgaaagcatcacccgaagtccgaactcttgccccgaatcaagcccatgttcgacggcaacgcgaggtgtccaatgggtccaaaatacggcgcgcttccagaagaagtcgaaccgttgctccgggcagctcaggccgctcggctcaccgtctccggtgtttccttccacatcggtagcggagatgccgattcaaacgcttatctcggcgccatagccgcggctaaggaagtgtttgaaacagctgctaaactcggtatgtcgaaaatgactgttctagacgtcggcggcgggtttacatccggccaccagttcacaaccgccgccgtcgctgttaaatcagctttaaaacaacacttcgacgacgaaccggagttgacaatcatagctgaaccgggccggttttttgcggagacggcgtttactttagcgacgacggttatagggaaaagagtgaggggagaattgagggagtattggatcaacgacgggttgtacggttcgatgaactgcgtactttacgaccatgcgacggtgaatgcaacgccgttagctgttttgtcgaatcgtactaacgttacctgcggcgggtcgaaaacgtttccgacgactgtgtttgggcccacctgtgatgctcttgatactgttttacgggattaccagttaccggagctgcaggttaatgattggctagtttttcctaatatgggtgcttatactaaagctgctgggtccaattttaatggatttaatacgtccaccattgttactcacctcgcttatacttatccaagctga

SEQ ID NO: 24 - protein, 432 aa, Nicotiana glutinosa
MAGQTIIVSGLNPAAILQSTIGGGASPTAAAAENGTRKVIPLSRDALQDFMLSIITQKLQDEKQPFYVLDLGEVVSLMDQWKSSLPNIRPFYAVKCNPEPSFLSILSAMGSNFDCASRAEIEYVLALGISPDRIVFANPCKPESDIIFAAKVGVNLTTYDSEDEVYKIRKHHPKSELLPRIKPMFDGNARCPMGPKYGALPEEVEPLLRAAQAARLTVSGVSFHIGSGDADSNAYLGAIAAAKEVFETAAKLGMSKMTVLDVGGGFTSGHQFTTAAVAVKSALKQHFDDEPELTIIAEPGRFFAETAFTLATTVIGKRVRGELREYWINDGLYGSMNCVLYDHATVNATPLAVLSNRTNVTCGGSKTFPTTVFGPTCDALDTVLRDYQLPELQVNDWLVFPNMGAYTKAAGSNFNGFNTSTIVTHLAYTYPS

SEQ ID NO: 25 - DNA, 1879 bp, Ornithorhynchus anatinus
aaaacttatagtgcatcggctgcaccaaggacacaaacataacctgcatttctcaggactttctttcctgaagaaataccctaggtgtctagctggaaagagctttactgtttcatctcctagttttccgtattgttgcactttagaagaataacaaggaatcatgaataacttcagcaatgatgagtttgactttacattccttgatgaaggatttactgccaaggatatcctggaccaaaaaatcaatgaagtttcttcctctgatgataaagatgccttctacgttgctgacctcggggatgtcctaaaaaaacacttgcgatggtacaaagccctccctcgagtcactcctttttatgctgtcaaatgtaatgacagcaaagctattgtgaagacgcttgctgctttaggggctggattcgattgtgccagcaagaccgaaattcagttggtgcagagcatcggtgtgtctccagagagaataatttatgcaaatccatgtaaacaagtgtcccagattaagtatgctgccaacagtggagtgcagatgatgacttttgatagtgaagttgagttaatgaaagttaacagagctcatccaaaggcaaagttggtcctgcggattgccactgacgactccaaagcagtctgtcgcctaagtgtcaaattcggtgccacactcaaaacgagcaggcttctcctggaacgggctaaagaactcaacattgatgttattggagtcagctttcatgttgggagtggttgtaccgatccagacacctttgtccaggcagtgactgatgcccggtgtgtcttcgacatgggagctgagcttggttttgatatgtatctgctggatattggaggaggtttccctggctctgaagatgtgaagctcaagtttgaagagatcacaagtgtcatcaatccagcattggagaagtactttccttctgattcaggagtgagaatcattgctgaaccgggcagatactatgttgcatcagctttcacacttgctgttaatatcattgccaaaaaagttgtattaaaagaacagacaggttctgatgatgaagatgatgttaatgacaaaactataatgtattatgtgaatgatggagtatatggatcatttaattgcatcttgtacgatcacgcgcacgttaaaccgattctacaaaagagacccaaaccagatgagagctactattcctgcagcatttggggtccaacgtgtgatgggctcgatcgtatcgttgagcgctgcgatatgccagaattgcaagttggagattggatgctttttgaaaatatgggtgcctacactgttgctgctgcttctactttcaatggattccagaggccaactatatattatgtgatgtcaggtccagcatggcaacgaatgcaacaaatcaacgagcgaggttttccagcagaagtagaggagccagaaaacaacactttgcccttgtcttgtgcttgggaaagcggcatggaacatcacccggcaacttgtgcttcggctagtattaacgtatagatacttgtgtgtagtctcttttaccagcgagtgtagcttgaatttagggcattttcggggaccattaacttaattcctgctagtttttttaaaaatgtgttcaagagtagggttggcataaatgcgacgaaatggatgactagaagatggggtcacatttatctgtgttcctatggaaactatttgaatatttgttttatatggatttttattcacttttcaactatgctactaaagattgtccctccactgtttgaacaagcgtttgtagcttgtgtaacagcagaatgggctgagcttagtgttgtgacctgttttaaaataaaatat

SEQ ID NO: 26 - protein, 461 aa, Ornithorhynchus anatinus
MNNFSNDEFDFTFLDEGFTAKDILDQKINEVSSSDDKDAFYVADLGDVLKKHLRWYKALPRVTPFYAVKCNDSKAIVKTLAALGAGFDCASKTEIQLVQSIGVSPERIIYANPCKQVSQIKYAANSGVQMMTFDSEVELMKVNRAHPKAKLVLRIATDDSKAVCRLSVKFGATLKTSRLLLERAKELNIDVIGVSFHVGSGCTDPDTFVQAVTDARCVFDMGAELGFDMYLLDIGGGFPGSEDVKLKFEEITSVINPALEKYFPSDSGVRIIAEPGRYYVASAFTLAVNIIAKKVVLKEQTGSDDEDDVNDKTIMYYVNDGVYGSFNCILYDHAHVKPILQKRPKPDESYYSCSIWGPTCDGLDRIVERCDMPELQVGDWMLFENMGAYTVAAASTFNGFQRPTIYYVMSGPAWQRMQQINERGFPAEVEEPENNTLPLSCAWESGMEHHPATCASASINV

SEQ ID NO: 27 - DNA, 1233 bp, Oryza sativa
atggctggaggaagacccttggagtcggtgctcgtggcccccggggtgaagggaaagaaggtactcgcattcaagcgcgacgggctcaagaaaaacgaggcagtgacgggcctcatccacgacatcgtcgccagctccagcgccaggagcgcgttccacgtcctggacctcgccaaggtggtcgacctctacgcgggatggcgccgcgcgctccccggcgtgaggcccttctacgccgtcaagtgcaacccggacacggcgctgctcggcgcgctcgccgcgctcggcgccggcttcgactgcgccagccgcgccgagatcgaggccgtcctcgcgctcggcgtcccgcccgccgccatcgtctacgctaacccgtgcaagcccggcgcgcacgtcgcgttcgccgccgaggccggcgtcaacgtcaccacgtacgattccgaggaggaggtggccaaggtgaagcgctgccaccccagttgcgagctgctgctccgcatcaaggcgccggactgcggcggcgtcaaggtcgacctcggcctcaagtacggcgccaacccggacgaggtgctgccgctgctgcgcgccgcgcgccgcgcgggcctcggcgtggccggcgtgtcgttccacgtcggcagcggcgcgtcccgcgcggccgtctaccgcggcgccatcgaggccgcgcgcgcggcgttcgacgcggccgcggggctcgggatgccgccgatgcgcgtcctgaacatcggcggcgggttcgtcgccggcgccgcgttcggcgacgcggcggcggtaatcaaccgcgcgctcgggcgctactttggcgacctcctccccaccgtcgagttgatcggcgagcccggccggtacttcgccgagaccgccttcacgctcgccgcgcgcgtcatcgggaagcgcaggcgcggcgacgtgcgcgagtactggatcgacgacggcgtctacggctcgctcaactgcatcctcctggacagctacgtgccgcgcccgaggccgctcgccggcgcgcgccccggcgaggagacgcacgcctcgacggtgttcgggccgacgtgcgactccatcgacacggtggtgaccgggtaccagctgccggagatgagcgtcgacgactggcttgtgttcgacgacatgggcgcctacaccactgcggccggctccagcttcaacggctttgccacgtcagccataaacacctacctggcatactccagctag

SEQ ID NO: 28 - protein, 410 aa, Oryza sativa
MAGGRPLESVLVAPGVKGKKVLAFKRDGLKKNEAVTGLIHDIVASSSARSAFHVLDLAKVVDLYAGWRRALPGVRPFYAVKCNPDTALLGALAALGAGFDCASRAEIEAVLALGVPPAAIVYANPCKPGAHVAFAAEAGVNVTTYDSEEEVAKVKRCHPSCELLLRIKAPDCGGVKVDLGLKYGANPDEVLPLLRAARRAGLGVAGVSFHVGSGASRAAVYRGAIEAARAAFDAAAGLGMPPMRVLNIGGGFVAGAAFGDAAAVINRALGRYFGDLLPTVELIGEPGRYFAETAFTLAARVIGKRRRGDVREYWIDDGVYGSLNCILLDSYVPRPRPLAGARPGEETHASTVFGPTCDSIDTVVTGYQLPEMSVDDWLVFDDMGAYTTAAGSSFNGFATSAINTYLAYSS

SEQ ID NO: 29 - DNA, 1245 bp, Oryza sativa
atggttggaggaagccccatgcaggccgtgctcatggcccccggcgtcaaggacaagaaggtgctcgccttcaagcgcggcaagggcaaggacgccgacgccggcgtcacggcgctcatccgcgacatcgtcgccggcggcgcccggagcgcgttccacgtcttcgacctcgccaaggtcgtcgacctccaccgcgggtggcgccgcgcgctccccgacgtgcgcccctgctacgccgtcaagtgcaaccccgacggcgccatgctcgccgcgctcgccgcgctcggcgccggcttcgactgcgccagccgcgccgagatcgaggcagtgctcgcgctcggcgtccgccccgccaccatcgtctacgccaacccgtgcaagcccgaggcgcacctcgagtacgccgccgaggtcggcgtcaacctcaccacctacgactccgaggaggaggtggccaaggtccggcgatgccacccgcgctgcgagctgctgctccgcatcaaggcgcccgactccggcgacgccaaggtcgacctggggctcaagtacggcgccaacccggacgaggtgctaccgctcctccgcgccgcgcagcgcgagggcgtcgccgtcgccggcgtctccttccacgtcgggagcggcgcgtcccgcgccgacgtctaccgcggcgccatcgaggcggcgcgcgaggcgttcgacgccgcggcggcgctcggcatgccgccgatgcgcgtcctcgacatcggcggcggcttcatggccggccggaccttcgacgaggcggcggcggtcatcaaccgcgcgctggagcgccacttcggcgacctcccctgcgtcgaggtgatcggcgagcccgggcggtacttcgccgagacggcgttcaccctcgccgcgcgcgtcatcgggaagcgcacccgcggcgagctccgggagtactggatcgacgacggcctctacggctccctcaactgcatcctcatggaccactacgtgccgcgcccgaggccgctcgccgccgccgccgccggcgaggacacgacggcggcgacgacgcacgcctcgacggtgttcggcccgacgtgcgactccctcgacacggtggtcaccggctaccagctgccggagatgagcgtcggcgactggctcgtgttcgacgacatgggcgcctacaccaccgcggctggctccaacttcaacggcttcgccacgtcagcgataaagatccacctggcatactccagctag

SEQ ID NO: 30 - protein, 414 aa, Oryza sativa
MVGGSPMQAVLMAPGVKDKKVLAFKRGKGKDADAGVTALIRDIVAGGARSAFHVFDLAKVVDLHRGWRRALPDVRPCYAVKCNPDGAMLAALAALGAGFDCASRAEIEAVLALGVRPATIVYANPCKPEAHLEYAAEVGVNLTTYDSEEEVAKVRRCHPRCELLLRIKAPDSGDAKVDLGLKYGANPDEVLPLLRAAQREGVAVAGVSFHVGSGASRADVYRGAIEAAREAFDAAAALGMPPMRVLDIGGGFMAGRTFDEAAAVINRALERHFGDLPCVEVIGEPGRYFAETAFTLAARVIGKRTRGELREYWIDDGLYGSLNCILMDHYVPRPRPLAAAAAGEDTTAATTHASTVFGPTCDSLDTVVTGYQLPEMSVGDWLVFDDMGAYTTAAGSNFNGFATSAIKIHLAYSS

SEQ ID NO: 31 - DNA, 1170 bp, Phaeodactylum tricornutum
atgcctttggaagactctttttacgttgtcgacattggtgtcctcgtttctcaggtctaccaatggagacgagtctttccacgtgtggagcctttttacgctgtcaagtgcaaccccgaccctctaattgtcaagaccctagcgacgctaggctgcaactttgattgtgcgagtcgcaacgaaatacgtctggtgatggaagccacaaaagacatgcccaccaagcccgacatcatctacgccaatccctgcaaatcgcgactcgggctcctcgaagccgtttgcaagggcgttaaaatggttaccttcgacaacgaaatggaagttcaaaagtgtgcctccatttcgaaaaacattcaactcgtcctccgcatcatcaccgatgaccggggatcccagtgtcgtctttcttccaagtttggtgcgcctcgtcacaaatggcgcctattgctggccgctgcacaaaagcacggcctccaagtggtcggggtgtcctttcatgtcggctccggctgccgcgacgcttcccgctacgaagcagccctgaaagacgccagggaaatcttcgaccttgctggagagtacggcatgaatatgcaagtcttggacattggcggtggtttcccgggagaaacacacagggatggccactttatgtatttcactgaaattgccgaacaagtggctccgctcattgacgaaatgtttcctccctccgttcgcatcattggtgaacctggacgctactttgtcgctgcctgtgctactttgtgctgctccgtaattgcggctcgtacgaatgaaatgaattcttccttcgaacccgaagcgattgatgacaaggaggccgccgaaaacctgccccctctccaggacgactactcctactacatcaacgatggtgtgtacggggccttcaacaacattatgttcgaccatgccacggtgcgtcctcgcattcttggacccggagaaaagattgtagccacggaagaggatgtgtttggacctacatgcgactcgattgacgtgattgcccgatcggttctacttcccaaactcaaggtgggcgactacatgtattttcaaaacatgggagcttacactatggcagctgccagctcgttcaacggttttactcctagcgagaagttctatgtttgctccgtc

SEQ ID NO: 32 - protein, 390 aa, Phaeodactylum tricornutum
MPLEDSFYVVDIGVLVSQVYQWRRVFPRVEPFYAVKCNPDPLIVKTLATLGCNFDCASRNEIRLVMEATKDMPTKPDIIYANPCKSRLGLLEAVCKGVKMVTFDNEMEVQKCASISKNIQLVLRIITDDRGSQCRLSSKFGAPRHKWRLLLAAAQKHGLQVVGVSFHVGSGCRDASRYEAALKDAREIFDLAGEYGMNMQVLDIGGGFPGETHRDGHFMYFTEIAEQVAPLIDEMFPPSVRIIGEPGRYFVAACATLCCSVIAARTNEMNSSFEPEAIDDKEAAENLPPLQDDYSYYINDGVYGAFNNIMFDHATVRPRILGPGEKIVATEEDVFGPTCDSIDVIARSVLLPKLKVGDYMYFQNMGAYTMAAASSFNGFTPSEKFYVCSV

SEQ ID NO: 33 - DNA, 1581 bp, Solanum lycopersicum
cactctatatattatggttaatattatttgaggttactccgtctcaaagggaacagagaaattcatatatttttcggtattccttcttctctttgaatggccggccaaacagtcattgtttccggtttgaatccggcggccattcttcagtccacaatcggtggagctccggtggcagcggcggcggagaacggccatacgagaaaagttgttcctctgtcaaaagatgcccttcaggatttcatggtttcaatcataacacagaaattacaggacgataaacaacccttttatgttctagatttgggtgaagttgtttcccttatggaacaatggaactctgctttaccaaatatccgtccgttttatgctgttaaatgtaaccctgaaccttcatttctctccatgttgtctgctatgggttccaattttgattgtgctagccgtgctgaaattgagtatgttttgtctcatggtatctcgccggaccggattgttttcgctaacccttgtaagccggaatccgatattatcttcgccgagaaaattggggttaatctcactacttacgattccgaggatgaagtttacaagatccgtaaacatcacccaaaatgcgagcttttgcttcgaatcaaacccatgaccgacggcaacgcgagatgcccaatgggtccaaaatacggcgcattaccggaggaaatcgagccgctcctccgtacagctcaagccgctagactcaccgtctccggcgtgtccttccatatcggcagcggagacgccgattccaacgcttatctaggagccatagccgcagcgaaacaggttttcgaaacagcagctcaactcggaatgccaaaaatgacggtactcgacatcggcggcggatttacctccggccaccaattcaccaccgctgctcccgccgttaaatcagctctggaaacccacttccacgacttccctgagctaaccatcatcgctgaaccaggtcgtttcttcgccgaaacagcgttcactttagcaacaaccatcatcggcaaaagagtcagaggtgaattaaaagaatactggatcaacgatgggttatacggatcgatgaactgtgtactttacgaccatgcgacggtgacggcgacgccattagcgtgcatgtcgaatcgtaataacctcaactgcggcgggtcgaaaacgtttccgtcgactgtattcgggcccacctgtgatgcacttgataccgtgttaagggattaccagttaccggagctacaggttaatgactggctgatttttcctaatatgggtgcttatacaaaagctgctggatcaaatttcaatggatttaacacatccgccattgttactcaccttgcttatgcttatccaaactaatgattaattaggctttaattagcatggtcattgtaattttttttcttctaattttgttcttgtttggtaatttattttccaatcagcttgtagtttcttttttctttttggtctcataagataagcaaggattagtcaattggatttgcatgtacttatattttatgtctaaataatccaatttcatgt

SEQ ID NO: 34 - protein, 431 aa, Solanum lycopersicum
MAGQTVIVSGLNPAAILQSTIGGAPVAAAAENGHTRKVVPLSKDALQDFMVSIITQKLQDDKQPFYVLDLGEVVSLMEQWNSALPNIRPFYAVKCNPEPSFLSMLSAMGSNFDCASRAEIEYVLSHGISPDRIVFANPCKPESDIIFAEKIGVNLTTYDSEDEVYKIRKHHPKCELLLRIKPMTDGNARCPMGPKYGALPEEIEPLLRTAQAARLTVSGVSFHIGSGDADSNAYLGAIAAAKQVFETAAQLGMPKMTVLDIGGGFTSGHQFTTAAPAVKSALETHFHDFPELTIIAEPGRFFAETAFTLATTIIGKRVRGELKEYWINDGLYGSMNCVLYDHATVTATPLACMSNRNNLNCGGSKTFPSTVFGPTCDALDTVLRDYQLPELQVNDWLIFPNMGAYTKAAGSNFNGFNTSAIVTHLAYAYPN

SEQ ID NO: 35 - DNA, 1790 bp, Schizosaccharomyces pombe
aaaacagtgacaagtgggtaagaaaaagaatctggaaggataaacgctctttttgcgcgaccaccaaaagtatataaaagtgcaaatttccgtctacgtctcctatttaagacaatctctcgaataaggactttttgatcaacagcagatttcaaatcattgattgatttgaaatagtaaaattattgtaaagcgagcagttgacaaacaaaacgtttgtttagcttgtatccgaagaaaaattattcaacgattcaatttagtgatctcggaatttctagaagagaaaaagcttacttacacgatgcctgctattatggaaaagaatatgctcgtcagcgagtcgttgcgtacgacggaattacttggccatgttaaaccaattgactcagtggtgacatggtcttcgcctggatcgtctcgccaggcgattggtgaggcgtttaaaaacacgattgaggaaattgagcgtgcagctgtccgtggtgaacccgctgactctgatgcattttttgttgctgatttgaacggagtatatcgccaacttcttcgttggcatgctaaattacctcgtgttcaaccattttatgcagtcaaatgtaatcctgatcctaaggtacttgcattgcttaataaatttggaactggttttgactgtgcttctaagggtgaactcgaacaaattcttggcttaggtgtatcccctgatcgaattgtatacgccaatccttgtaaagccataacttatgtgcgctatgctgcttctaaaggcattaatctgatgacttttgataatgccgatgagctgtacaaggtgaaacaacatcatcccaactcacgtcttcttcttcgtatttctaccgatgattccaatagtctttgccgtctcagtctaaagtttggtgcttctctcgatgatactggtaagctgctagacatcgcaaagtccctggagttaaatgtcgtcggtgttagctttcacgttgggtcaggaagctatgatccctcagcatttttggatgctatccaacgatctcgtcaggtatttgatcagggacttgaaaggggatttaattttgacttgttggacattggtggtggtttcatgaatgacagctttgatggcgtagcagaccttattcgctctgccttggatacttattttgatccctccatccgtgttatttctgagcccggtcgctttttcgtctcttcttcgtttactttggctgtcaatgtaattgccaaacggaagcttgatgatgaagagaaggtgatgtattacgtaaacgatggtgtttatggtagccttaattgtattttgtttgaccatcaacatccagttgctcgagttctaaagtgtggaagtcggtttgtgtacaatgatttggttggcaccggccaacatcgttgttttatttggggtcctacttgcgattcattggatgtgatagctaacgatgcccatcttccttatgagctcaacgtcggtgactggatatattttgaagatgcgggagcttacactgttgcagctgctagctgttttaacggttttaaaaccagtcgcattgtgtaccttgatacggatatccttgattaaattattttaaagatcggtgtaagtttattctacattgcataatctcttttctcttactacatatactaattccatactggttggatttaaatcaaaattatttctgtgctattgttcgcctttcaagctttattgttacgtttaaataaaattacaatcaaaaagttatatgctttatgaatctaaa

SEQ ID NO: 36 - protein, 432 aa, Schizosaccharomyces pombe
MPAIMEKNMLVSESLRTTELLGHVKPIDSVVTWSSPGSSRQAIGEAFKNTIEEIERAAVRGEPADSDAFFVADLNGVYRQLLRWHAKLPRVQPFYAVKCNPDPKVLALLNKFGTGFDCASKGELEQILGLGVSPDRIVYANPCKAITYVRYAASKGINLMTFDNADELYKVKQHHPNSRLLLRISTDDSNSLCRLSLKFGASLDDTGKLLDIAKSLELNVVGVSFHVGSGSYDPSAFLDAIQRSRQVFDQGLERGFNFDLLDIGGGFMNDSFDGVADLIRSALDTYFDPSIRVISEPGRFFVSSSFTLAVNVIAKRKLDDEEKVMYYVNDGVYGSLNCILFDHQHPVARVLKCGSRFVYNDLVGTGQHRCFIWGPTCDSLDVIANDAHLPYELNVGDWIYFEDAGAYTVAAASCFNGFKTSRIVYLDTDILD

SEQ ID NO: 37 - DNA, 1580 bp, Solanum tuberosum
gagaaaaacacacaaactatatttgggtccctattttctttgtttccctttgattccttcttctctttggatggccggccaaacagtcattgtttccggtttgaatccggcggccattcttcagtccacaatcggcggagttccggtggcagcagcggcggagaacggccataccagaaaagttgttcctctgtcaaaagatgcccttcaggatttcatggtttcaatcataacccagaaattacaggacgataaacaacccttttatgttctagatttgggtgaagttgtttcccttatggaacaatggaactctgctttaccaaatattcgtccgttttatgctgtgaaatgtaaccctgaaccttcatttctctccatgttgtctgctatgggttccaattttgattgtgctagccgtgctgaaattgagtatgttttgtctcttggtatctcgccggaccggattgttttcgctaacccttgtaagccggaatccgatatcattttcgccgagaaaattggggttaatctcacaacttacgattcagaggatgaagtttacaagatccgtaaacatcacccgaaatgcgagcttttgcttcgaatcaaacccatgaacgacggcaacgccagatgcccaatgggtccaaaatacggcgcattaccggaagaaatcgagccgctcctccgtacagctcaagccgctagactcaccgtctccggcgtttccttccatatcggcagcggagacgccgattccaacgcttatctaggagccatagccgcagcgaaacatgttttcgaaacagcaactcaactcggaatgccaaaaatgacggtactcgacatcggcggcggatttacctccggccaccaattcacctccgctgctcccgccgtgaaatcagctctggaaacccacttccagaactccccggagctaacaatcatcgctgaaccgggtcgtttcttcgcagaaacggcgttcactttagcaacaaccatcatcggcaaaagagtcagaggtgaattaaaagaatactggatcaacgatgggttatacggatcgatgaactgtgtactttacgaccatgcgacggtgacggcgacgccattagcgtgcatgtcgaatcgtaacaacctcaactgcggcgggtcgaaaacgtttccgtcgactgtattcgggcccacctgtgatgcacttgataccgtgttgagggattaccagttaccggagctgcaggttaatgactggctggtttttcctaatatgggtgcttatacaaaagctgctggatcaaatttcaatggatttaatacatccgccattgttactcaccttgcttatgcttatccaagctaatgattaattaggcttaaattagcatggtggttgtaattttatttttttcttctaattttgtcgttgtttggtaatttatttgccaatcagcttgtagtttcttttttgtctcataagaaaagcaaggatttgccaattggatttgcttgtagttatattttatgtctaaataatccaatttcatctattgaattttatgttcgagaaagggggc

SEQ ID NO: 38 - protein, 431 aa, Solanum tuberosum
MAGQTVIVSGLNPAAILQSTIGGVPVAAAAENGHTRKVVPLSKDALQDFMVSIITQKLQDDKQPFYVLDLGEVVSLMEQWNSALPNIRPFYAVKCNPEPSFLSMLSAMGSNFDCASRAEIEYVLSLGISPDRIVFANPCKPESDIIFAEKIGVNLTTYDSEDEVYKIRKHHPKCELLLRIKPMNDGNARCPMGPKYGALPEEIEPLLRTAQAARLTVSGVSFHIGSGDADSNAYLGAIAAAKHVFETATQLGMPKMTVLDIGGGFTSGHQFTSAAPAVKSALETHFQNSPELTIIAEPGRFFAETAFTLATTIIGKRVRGELKEYWINDGLYGSMNCVLYDHATVTATPLACMSNRNNLNCGGSKTFPSTVFGPTCDALDTVLRDYQLPELQVNDWLVFPNMGAYTKAAGSNFNGFNTSAIVTHLAYAYPS

SEQ ID NO: 39 - DNA, 1745 bp, Theobroma cacao
accagggatttgtactttgattcattgttcacactttggatttcctgcaattactgttgccttttgggatagttacttttggtgcttgattcttcaaggatgaaaaaggctattcaattatagacacctttttctccttttcctccaccaccatctcatgatgtggtgccaccctgaccctgtctctttatatatagccacccagagtacgattatagtgcttctactttcggaattctcatcttgctgttaaaagccttatactttttagttctttctgagtctatttaggttgccatgggatccagccccaggaccctccaagccattgtgggtgcgcctggggtgagaggaaagaaggtcgccgctctgtcgaaagatggtttgactgctttcattcagtcaatcgtttccaccaaacaagaaatgaaagagcccttttacgtgctggatttgggtgttgtcatggctctgtttgacaagtgggcccgtaaccttcccatggctcaacctttctacgccgttaagtgtaaccccaacccagctttgcttggggcattagctaccctgggctcaggcttcgactgtgcaagtaaggccgagattgaatccgttttgtctcttggtgtttcacctggtagaatcatctttgctaatccatgcaaagcagagtcccacatcaagtatgctgcaacagtcggtgttaacctgacaactttcgactccaaagaggaacttgagaagattaagaagtggcaccctaaatgtgccttattgatccgagtcaaggccccggatgatggcggcgcaagatgccctttaggtcccaagtacggtgcacttccggaggaagtcacccctcttctccaagctgctcaaactgcacggctcaccgttacaggagtctcgttccacattggcagtggagccatgcagtttcgagcctatcgagaagccatagcagcagctaaaactgtgtttgaaacggctgctagacttggcatgcccaaaatgcatgtgctaaacatcggtggagggttcacagccggcccacaattcgctgaagcagcgtcaacggtgaaagccgctctccaagcgtatttcccaaacgagccaagcttaacagtaattgcggagcctggtcgtttttttgcggagtcagctttcaccctagccaccaacattataggaaagcgcgttaggggtgatttaagagagtattggatcaacgatgggatctacggctcaatgaactgtattctctatgaccatgcggtcgtcacctgcatgcctctcgcaagagcatccagtcccaggtgcaaaggagccaggacctacgattccaccgtgtttggacccacgtgcgatgcgcttgacacggtcttgaaagtttatccgctgccagaactgcaagtgaacgactggctggtgtttcccaacatgggggcttacacggcggctgctgggtccaatttcaatgggttcaacacgtcagccatcctgacgtaccttgcttattccaacccaaattgagtgaggcccttggcgaactggactgcatggtttcgtgtttgacatgccatcgatgctctcatcatttggtttgcgattgttgtgaattattttatatcgttatattagtttctgcttgaaatttgtatcttctctattggaatatgattctgcaactaaaaatttagacacctaatgctaataagacagtatcttctattccaaaaaaaaaa

SEQ ID NO: 40 - protein, 411 aa, Theobroma cacao
MGSSPRTLQAIVGAPGVRGKKVAALSKDGLTAFIQSIVSTKQEMKEPFYVLDLGVVMALFDKWARNLPMAQPFYAVKCNPNPALLGALATLGSGFDCASKAEIESVLSLGVSPGRIIFANPCKAESHIKYAATVGVNLTTFDSKEELEKIKKWHPKCALLIRVKAPDDGGARCPLGPKYGALPEEVTPLLQAAQTARLTVTGVSFHIGSGAMQFRAYREAIAAAKTVFETAARLGMPKMHVLNIGGGFTAGPQFAEAASTVKAALQAYFPNEPSLTVIAEPGRFFAESAFTLATNIIGKRVRGDLREYWINDGIYGSMNCILYDHAVVTCMPLARASSPRCKGARTYDSTVFGPTCDALDTVLKVYPLPELQVNDWLVFPNMGAYTAAAGSNFNGFNTSAILTYLAYSNPN

SEQ ID NO: 41 - DNA, 1167 bp, Thermotoga maritima
atgatggaatactggattagaagagcccttgaagtagtgaaaacgccttttcttcttttcgatctgtcggtcgtggaaaagaaatatctggagatgaaagctgctctcaaaaaagcggatatttactacgctgtgaaggcaaactcccacccgcgtattatatcccttcttgccaggttggggagtaatttcgatgtggcttccaagggggagatagaaaagctcctcgcacttggtgtggatgggaagagaatgagttttggtaacaccataaaaagagaggaagacatcgcgttcgcgtacaaaaacggtataaggctctttgcagtggatagtgagatggaagtggaaaaagtcgctataaatgctcctggaagcttcgtttttgtgagagtggaaacggatggtgcagacgcagactggcccctttccagaaagtttggaaccaatccagagcatgctcttcagcttctctcctatgcttcgaagatgaaactgatccccgcgggattgagttttcacgtgggatctcagaatttgaatcctgaaagctggaaaaaggcgatagagatcgcggggagagtgttcaaaaaagccatgagatccggtttgaatcttttcctcttgaacgttggtggaggctttcctgttcagcacacaaagccaattccaagtatggaagaaataggaaaggcaatcgaagaggcgatagacgaaaacctctggtttgtccacaatttgaaagtgatagccgagcccggaaggtacatggtcggagaagcaggctggcttgtcacaaaagtgcttttgaagagcgaaagatcaggtgaaaaatgggtttacatcgacgcgggagtatttcacgggctcgcagaaactatccaaaacttcgagtacgaaatcagagtcctcggaaaagaaagagaagagctcgaagagtaccatctggcgggtcccacttgtgacagcgtggatgtgatatacgacagaatctttcttccaaagagcatcactctgaacgaccttgtgtgcttcataaacgcgggggcttacacggttgagtacaacacccgtttcaacggaatagaacctccaaagatggttttcatcgaagaactcacggagatctcaatagaggagaaaatcaaaacacgagtgctggattga

SEQ ID NO: 42 - protein, 388 aa, Thermotoga maritima
MMEYWIRRALEVVKTPFLLFDLSVVEKKYLEMKAALKKADIYYAVKANSHPRIISLLARLGSNFDVASKGEIEKLLALGVDGKRMSFGNTIKREEDIAFAYKNGIRLFAVDSEMEVEKVAINAPGSFVFVRVETDGADADWPLSRKFGTNPEHALQLLSYASKMKLIPAGLSFHVGSQNLNPESWKKAIEIAGRVFKKAMRSGLNLFLLNVGGGFPVQHTKPIPSMEEIGKAIEEAIDENLWFVHNLKVIAEPGRYMVGEAGWLVTKVLLKSERSGEKWVYIDAGVFHGLAETIQNFEYEIRVLGKEREELEEYHLAGPTCDSVDVIYDRIFLPKSITLNDLVCFINAGAYTVEYNTRFNGIEPPKMVFIEELTEISIEEKIKTRVLD

SEQ ID NO: 43 - DNA, 2268 bp, Volvox carteri
aaattgttatcatatttacgcattttgacgctgccccgctttcggcatccacaacttccccccgagcaaggaccgcttggcctgtatcggcccaagctggcgccccgtaattttgccacttctttattggctcaaagctcgacccttctgagacttctaagttctcagccttcattctctccttcggcaccaggttccttttccaacaggcctgtggcctcatgcgacggtatcccattgttacttcattgcctccggtgcgctctcccaggctaaatcgcgtcatcatgacaagttctgaggtcctgagtccccctccgccggctgcggtggcaagccttgctgcgccgcaactgcacagcgtggacctgcagtctctgcagctgcctctggttcccgacgttgtcagcgttgaaactggcgatgtctccgcctttaccaggagtgcttggcgcaacgacacgggcaagacgggcacctatgggcttccaactatgcttgatatgaaggcagaggcattggagatggtgcagttggacaactggagcgttcagcctgtggaccgcggcccggcaactgcggcccctgatccgaagctgctccgttcctggcagtaccaggcgacgggaaagcttgctacagcccaagtcttggtggacttgaaggctgagcacatcaagtcgggtggacccatgggtatgaagcaggaggcaatcaagcacatcgtaaagcacaagccagacgacaccttctatgtggtcgaccttgctaacgtacagcgcatgtttaaggcctggcgcgctgcgatgccccgcgtaatgccttactacgctgtcaagtgcaacccggagccagggatcctgaagttgctggtggcgatgggtgctggctttgactgcgcttccaagggcgagctcgacatgatgctgcgcatgggggtttcgcctagccgtatcattttcgctcacccgtgtaaacgagcgtcagacatccgctacgcccgagaccacggcattcagtacactacattcgacactgtgtcggagctttacaagatttctcaaatgaaccctgacttcaagtgcgtactccgtattcgcgcggacgaccccgatgcccgcgtcccgctgggcttgaagtatggcgctgaggtttcggaggcgccagttctcctgcagaccgccaaggaccttgggctccatgtcgtcggcgttagtttccacgtcggcagtgcatgccaaaacctctcgactttcagtggagctattgagaatgcccgcaaggtgttcgacgaggcccacacgttgggatttcacatggagctcctcgacattggtggcggctttactggccacttcgatgagatggggaacgtaatgttcggtgagattgccaacaccatcaacacagctttggctgcccacttcccgcctgagatgggagtccgtgtcatcgcggagcctggccgctacttcgccgagacgagtagcacattgctgaccccggtgtacggccagcgggaccgcgttgcgcatgatggagctgttaagaaggactactggctgacggatggtctctacggcagctttaactgcattctctacgatgggcagagtcccgcgtacaaggtcgttcgctctcccctgcttccggagccggctgatatccgcaccttcacgtccacgttgtggggccccacctgtgatagcgctgactgcgtgtacaaggacgtgcagttgcccgtacttcgcaacggagattggctgatgtggaataacgccggcgcttacaccgtcgctggtgcgtgcgacttcaatggcatcgagttcactactcccggcaagctctacgtctggtcggatagtgctgtggacgtcgagctggcagaggagaatgtcatggaagcgtgatgggctaaatttatgtacagcttctttttcatgttctgggatgtgaagcataactgtggtttgaccgttttttttgtcgaggctacggtctgattttaatgggtagtgaaactgtgtcaatgacgtttctatataacattgtctttttttccgattgtgaccttttatgtcaccaacttacgattggaattcaacaattcctacgcgtttcgataattgtaggactcggcaggatgcaatgctgtgtttccgctaactatcgtcaaatgaaaacattcatatgtgtcggctaggaaattcctaccggaagggcaccaatctatctgaggtatctaattgtaactaatagaaaggttta

SEQ ID NO: 44 - protein, 562 aa, Volvox carteri
MRRYPIVTSLPPVRSPRLNRVIMTSSEVLSPPPPAAVASLAAPQLHSVDLQSLQLPLVPDVVSVETGDVSAFTRSAWRNDTGKTGTYGLPTMLDMKAEALEMVQLDNWSVQPVDRGPATAAPDPKLLRSWQYQATGKLATAQVLVDLKAEHIKSGGPMGMKQEAIKHIVKHKPDDTFYVVDLANVQRMFKAWRAAMPRVMPYYAVKCNPEPGILKLLVAMGAGFDCASKGELDMMLRMGVSPSRIIFAHPCKRASDIRYARDHGIQYTTFDTVSELYKISQMNPDFKCVLRIRADDPDARVPLGLKYGAEVSEAPVLLQTAKDLGLHVVGVSFHVGSACQNLSTFSGAIENARKVFDEAHTLGFHMELLDIGGGFTGHFDEMGNVMFGEIANTINTALAAHFPPEMGVRVIAEPGRYFAETSSTLLTPVYGQRDRVAHDGAVKKDYWLTDGLYGSFNCILYDGQSPAYKVVRSPLLPEPADIRTFTSTLWGPTCDSADCVYKDVQLPVLRNGDWLMWNNAGAYTVAGACDFNGIEFTTPGKLYVWSDSAVDVELAEENVMEA

SEQ ID NO: 45 - DNA, 1491 bp, Vitis vinifera
atgcatgttctcgacattggaggagggttccaggaaagcccaacgttccacgaaattgctgcagtcataaaggaagccatcaatgattatttcccaagttctgaaacatctgaagatctcaagataatggctgagccagggagattctttgctgaaactgcattcacgctggtgtctaatataattgggaaacgggtgagaggcgagaagagagagtattggattgatgatgggatctacggatcctttaaccttccagcatatgataagtcgtccatgatggtgaaaccgctgcttggaggatcagaccgcttcttgggggatcagagagatggatttacggctctcatccgatcaatttcacagaaacaaaaggatcgtgagccattctacatattggatttgggagctgtagtgaggctcatggacatgtggaaacaagctcttcccaacgtggtgccatactatgctgttaaatgcaattgccaacctccattgatcactgcgcttgcctcactgggcgcaaacttcgactgcgcaagtcgtgctgagattgagacggtgatggcacttggagttggtgcccaacagattgtgtacgccaatccatgtaagggcgagtcccatctaaagtacgcagccagtgtgggggtcaacctcaccaccttcgactccatgcaggagattgataagattataatgtggcataaaaaatgcgacttgctgcttcgaatcaaggctccgaatgatgagaaaggttcatggcgttcgcttggatccaaattcggagcactgcgggaggaggtggtgccacttcttcagcacgccaatgcagcggggctgagggtaattggggtgtcattccacgtggggtctaaagtgaatgacccccaagtgtaccgtggagcaatagcttctgctaggggtgtgttcgacgcagctgcccagctgaagctgcctccaatgcatgttctcgacattggaggggggttccaggaaagcccaacgttccacgaaattgctgcagtcataaaggaagccatcaatgattatttcccaagttctgaaacatctgaagatctcaagataatggctgagccagggagattctttgctgaaactgcattcacgctggtgtctaatataattgggaaacgggtgagaggcgagaagagagagtattggattgatgatgggatctacggatcctttaaccttccagcatatgataagtcgtccatgatggtgaaaccgctgcttggaggatcagagtggatgaataaggctaaattctcttcgactgtgtttggaccaacgtgtgattccatggacatggtggtggctgaatctcaactgccggagctgcatatgaatgatgtgctagtgttctataacatgggggcatacactgcctctgctggaaccagattcaatggctttgacatatcatcaatttccaccttcctgacgtacgtttacaggcaatattaa

SEQ ID NO: 46 - protein, 496 aa, Vitis vinifera
MHVLDIGGGFQESPTFHEIAAVIKEAINDYFPSSETSEDLKIMAEPGRFFAETAFTLVSNIIGKRVRGEKREYWIDDGIYGSFNLPAYDKSSMMVKPLLGGSDRFLGDQRDGFTALIRSISQKQKDREPFYILDLGAVVRLMDMWKQALPNVVPYYAVKCNCQPPLITALASLGANFDCASRAEIETVMALGVGAQQIVYANPCKGESHLKYAASVGVNLTTFDSMQEIDKIIMWHKKCDLLLRIKAPNDEKGSWRSLGSKFGALREEVVPLLQHANAAGLRVIGVSFHVGSKVNDPQVYRGAIASARGVFDAAAQLKLPPMHVLDIGGGFQESPTFHEIAAVIKEAINDYFPSSETSEDLKIMAEPGRFFAETAFTLVSNIIGKRVRGEKREYWIDDGIYGSFNLPAYDKSSMMVKPLLGGSEWMNKAKFSSTVFGPTCDSMDMVVAESQLPELHMNDVLVFYNMGAYTASAGTRFNGFDISSISTFLTYVYRQY

SEQ ID NO: 47 - DNA, 1200 bp, Vibrio vulnificus
atggcacattcacaatctatttttgatattcattcactaacttcaccagtgctaagcgcagaagaaatccacttgatcgaagcgtcggttgagcaatttggtgcgccactcttgctattggactgcgatgtgattcgtcagcagtaccgcgctttgaaaaacgcgttgccaaacgtgacgctgcactacgcattaaaaccgctgccacacccagtggtggtgcgtactttgttagcagaaggggcgagtttcgaccttgcaacaacaggggaagtggagttggtcgcttctgaaggcgtaccggcggatctcactatccacactcacccaatcaagcgtgatgccgatattcgtgatgcactggcttacggttgcaacgtatttgtagtggataacttgaatgaactggaaaaattcaaagcgtatcgcgatgacgtcgagttattggtgcgcttgagcttccgcaattcagaagcgtttgctgacttgtcgaagaagtttggttgttcaccagagcaggcattagtgatcatcgaaacggcaaaagagtggaatattcgcatcaaaggtttgtcgttccatgtgggctcacaaactactaacccaaacaagtatgttgaagcgatccacacttgccgacatgtgatggaacaagtggttgaacgcggtttgccagcgttgagcacgcttgatattggtggtggcttccctgtgaactacacccaacaagtgatgccgattgatcaattctgcgcgccaattaatgaagcgctaagcttgttgccagaaacggtccacgttttggctgaaccgggtcgctttatctgtgcacctgcggtgaccagtgtggcttcagtgatggggcaagccgagcgtgaagggcaaatttggtactacttggatgacggtatttatggctcgttcagtggtttgatgtttgacgatgcgcgttatccgctcaccaccatcaaacaaggtggcgagctgatcccaagcgtactttctggcccaacgtgcgacagcgtggatgtgattgcagaaaacattctgctgccaaaattgaacaatggcgatttggtaattggccgcaccatgggtgcctacaccagtgcaaccgcgaccgattttaacttctttaaacgcgctcaaactattgcgctgaatgaatttgttgcaagcagcgaacgcatgattggctaa

SEQ ID NO: 48 - protein, 399 aa, Vibrio vulnificus
MAHSQSIFDIHSLTSPVLSAEEIHLIEASVEQFGAPLLLLDCDVIRQQYRALKNALPNVTLHYALKPLPHPVVVRTLLAEGASFDLATTGEVELVASEGVPADLTIHTHPIKRDADIRDALAYGCNVFVVDNLNELEKFKAYRDDVELLVRLSFRNSEAFADLSKKFGCSPEQALVIIETAKEWNIRIKGLSFHVGSQTTNPNKYVEAIHTCRHVMEQVVERGLPALSTLDIGGGFPVNYTQQVMPIDQFCAPINEALSLLPETVHVLAEPGRFICAPAVTSVASVMGQAEREGQIWYYLDDGIYGSFSGLMFDDARYPLTTIKQGGELIPSVLSGPTCDSVDVIAENILLPKLNNGDLVIGRTMGAYTSATATDFNFFKRAQTIALNEFVASSERMIG

SEQ ID NO: 49 - DNA, 1383 bp, Xenopus laevi
atgaacagcttcagcaatgacgactttgacttcagcttcctggaggaaggcttctctgccagggatattgtggagcaaaagatcaatgaagtgtccttatctgacgacaaagatgccttttatgttgctgatcttggcgacattgtgaaaaagcatgtgcgttggtttaaagcgctcccccgtgtcactccgttttatgccgtaaaatgcaacgatggcaaagccattgtgaagactctctccattcttggtgccggctttgactgtgccagtaagactgaaatccaactagtacagagtattggagtttcccccgagcggattatctatgcaaacccgtgtaaacaagtttcccagatcaaatacgcagctagctgtggtgtggagaagatgacttttgatagtgaagttgaattgatgaaagtggcaaggaatcacccgaatgcaaagcttgttctacgcatagcaactgatgactcaaaagcagtctgccgcctcagtgtgaaatttggtgccacccttaaaacaagcaggctgcttctggagcgggcaaaggagcttaatgtggatataattggtgtgagtttccatgttggcagtggctgcactgatccacagacttatgtacaagctgtctcagatgcacgatgtgtctttgacatgggggctgagcttggctttaacatgcatctacttgatattggtggtggattccctggttcagaggatgtgaaactgaagtttgaagagatcacatctgtgataaacccagccctggataaatacttcccagcagattctggcgttaaaatcattgcagagcctgggagatactatgttgcctcatctttcaccctggcagttaatatcattgccaagaaagttatggtgaatgagcaaagtggatctgatgatgaagaagatgctgccaatgacaaaactctgatgtactacgtcaatgatggagtgtatggatctttcaactgcatcttgtttgatcatgcacatgtcaagccagttctaacaaagaaacccaaaccagatgagaagttctactcgagcagcatttggggaccaacgtgtgatgggctggatcgtatcgtagaaaggtttgagctgccggagctgcaagttggagactggatgttgtttgaaaacatgggtgcctacactgttgctgcagcctcgacattcaatggatttcagagaccaaccctttattatgttatgtcaagaccacactggcaactgatgcatgatattaaagaacatggcattctccctgaagtaccagatctgagtgcactccatgtatcctgtgctcaggagagcggaatggaacttgcacctgctgtctgtactgctgccagcatcaatgtatag

SEQ ID NO: 50 - protein, 460 aa, Xenopus laevi
MNSFSNDDFDFSFLEEGFSARDIVEQKINEVSLSDDKDAFYVADLGDIVKKHVRWFKALPRVTPFYAVKCNDGKAIVKTLSILGAGFDCASKTEIQLVQSIGVSPERIIYANPCKQVSQIKYAASCGVEKMTFDSEVELMKVARNHPNAKLVLRIATDDSKAVCRLSVKFGATLKTSRLLLERAKELNVDIIGVSFHVGSGCTDPQTYVQAVSDARCVFDMGAELGFNMHLLDIGGGFPGSEDVKLKFEEITSVINPALDKYFPADSGVKIIAEPGRYYVASSFTLAVNIIAKKVMVNEQSGSDDEEDAANDKTLMYYVNDGVYGSFNCILFDHAHVKPVLTKKPKPDEKFYSSSIWGPTCDGLDRIVERFELPELQVGDWMLFENMGAYTVAAASTFNGFQRPTLYYVMSRPHWQLMHDIKEHGILPEVPDLSALHVSCAQESGMELAPAVCTAASINV

SEQ ID NO: 51 - protein, 41 aa, Artificial sequence
  Motif 1
  VARIANT (1)..(1): /replace = "Gly"
  VARIANT (4)..(4): /replace = "Val"
  VARIANT (6)..(6): /replace = "Met"
  VARIANT (7)..(7): /replace = "Ser"
  VARIANT (8)..(8): /replace = "Leu"
  VARIANT (10)..(10): /replace = "Phe"
  VARIANT (17)..(17): /replace = "Ala"
  VARIANT (22)..(22): /replace = "Gln"
  VARIANT (23)..(23): /replace = "Thr"
  VARIANT (25)..(25): /replace = "Lys"
  VARIANT (26)..(26): /replace = "Glu"
  VARIANT (27)..(27): /replace = "Leu"
  VARIANT (28)..(28): /replace = "Arg"
  VARIANT (32)..(32): /replace = "Val"
  VARIANT (38)..(38): /replace = "Ile"
NARCPLGPKYGALPEEVEPLLRAAQAAGLTVSGVSFHVGSG

SEQ ID NO: 52 - protein, 21 aa, Artificial sequence
  Motif 2
  VARIANT (1)..(1): /replace = "Asp"
  VARIANT (2)..(2): /replace = "Gln"
  VARIANT (3)..(3): /replace = "Ala"
  VARIANT (7)..(7): /replace = "Val"
  VARIANT (10)..(10): /replace = "Ala"
  VARIANT (11)..(11): /replace = "Val"
  VARIANT (14)..(14): /replace = "Arg"
  VARIANT (20)..(20): /replace = "Lys" /replace = "Asn"
  VARIANT (21)..(21): /replace = "Ser"
KDPFYVLDLGEVVSLMDQWRA

SEQ ID NO: 53 - protein, 42 aa, Artificial sequence
  Motif 3
  VARIANT (3)..(3): /replace = "Ile"
  VARIANT (4)..(4): /replace = "Tyr"
  VARIANT (10)..(10): /replace = "Arg"
  VARIANT (13)..(13): /replace = "His"
  VARIANT (15)..(15): /replace = "Lys" /replace = "Arg"
  VARIANT (16)..(16): /replace = "Phe"
  VARIANT (19)..(19): /replace = "Ser"
  VARIANT (27)..(27): /replace = "Phe"
  VARIANT (33)..(33): /replace = "Leu"
  VARIANT (34)..(34): /replace = "Glu"
  VARIANT (36)..(36): /replace = "Val"
  VARIANT (37)..(37): /replace = "Ala" /replace = "Lys"
RIVFANPCKPESDIIYAAKVGVNLTTYDSEDEVYKIRAKHHP

SEQ ID NO: 54 - protein, 21 aa, Artificial sequence
  Motif 4
  VARIANT (3)..(3): /replace = "Tyr"
  VARIANT (5)..(5): /replace = "Asp"
  VARIANT (8)..(8): /replace = "Val" /replace = "Ile"
  VARIANT (12)..(12): /replace = "Met" /replace = "Leu"
  VARIANT (15)..(15): /replace = "Val"
  VARIANT (17)..(17): /replace = "Phe"
EYWINDGLYGSFNCILYDHAT

SEQ ID NO: 55 - protein, 11 aa, Artificial sequence
  Motif 5
  VARIANT (8)..(8): /replace = "Ile"
EYVLSLGVSPD

SEQ ID NO: 56 - protein, 44 aa, Artificial sequence
  Motif 6
  VARIANT (3)..(3): /replace = "Glu"
  VARIANT (6)..(6): /replace = "Arg"
  VARIANT (10)..(10): /replace = "Asp"
  VARIANT (11)..(11): /replace = "Ala"
  VARIANT (13)..(13): /replace = "Se"
  VARIANT (14)..(14): /replace = "Gln" /replace = "Arg"
  VARIANT (15)..(15): /replace = "Phe"
  VARIANT (17)..(17): /replace = "Leu"
  VARIANT (18)..(18): /replace = "Ser"
  VARIANT (19)..(19): /replace = "Arg" /replace = "Pro"
  VARIANT (21)..(21): /replace = "Arg"
  VARIANT (24)..(24): /replace = "Asp"
  VARIANT (25)..(25): /replace = "Val"
  VARIANT (31)..(31): /replace = "Ala"
  VARIANT (33)..(33): /replace = "Pro"
  VARIANT (36)..(36): /replace = "Glu"
  VARIANT (37)..(37): /replace = "Glu"
  VARIANT (40)..(40): /replace = "Val"
  VARIANT (41)..(41): /replace = "Lys" /replace = "Val"
  VARIANT (42)..(42): /replace = "Ile"
  VARIANT (43)..(43): /replace = "Asn"
  VARIANT (44)..(44): /replace = "Ala"
AIAAAKEVFETAAKLGMPKMTVLDIGGGFTSGHQFTTAAAAVKS

SEQ ID NO: 57 - protein, 41 aa, Artificial sequence
  Motif 7
  VARIANT (1)..(1): /replace = "Ile"
  VARIANT (3)..(3): /replace = "Ala"
  VARIANT (6)..(6): /replace = "Thr"  /replace = "Val"
  VARIANT (11)..(11): /replace = "Glu"
  VARIANT (12)..(12): /replace = "Asn"
  VARIANT (13)..(13): /replace = "Asp" /replace = "Gly"
  VARIANT (14)..(14): /replace = "His"
  VARIANT (19)..(19): /replace = "Ile"
  VARIANT (23)..(23): /replace = "Lys"
  VARIANT (31)..(31): /replace = "Leu"
  VARIANT (41)..(41): /replace = "Asp"
GGGAPPAAAAAENGTRKVVPLSRDALQDFMVSIITQKLQDE

SEQ ID NO: 58 - protein, 15 aa, Artificial sequence
  Motif 8
  VARIANT (3)..(3): /replace = "Ile"
QTVIVSGLNPAAILQ

SEQ ID NO: 59 - DNA, 50 bp, Artificial sequence
  PRIMER 1
ggggacaagtttgtacaaaaaagcaggcttaaacaatggccggccaaaca

SEQ ID NO: 60 - DNA, 50 bp, Artificial sequence
  PRIMER 2
ggggaccactttgtacaagaaagctgggttacaggtggttcatcagcttg

SEQ ID NO: 61 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 62 - DNA, 1191 bp, chlamydomonas reinhardtii
atggaaggaattgccaactccaggtggttgctgacgttgtgcgttccgttttctcctctccctcaggcctggcgcgccgctatgccccgcgtggtccccttctacgcggtcaagtgcaacccggagccgggtatcctgaagctgctgaacgcgctgggtgctggcttcgactgcgctagcaagggcgagctggacatgatgctgcgcatgggcgtctcgcccaaccgcattatctttgctcacccctgcaagcgcgcctcggacatccgctacgcgcgcgagcacaacgtgcagtacaccacgttcgacaccgtgtcggagctgcacaagatcgcgcagatgaaccccgacttcaagtgcgtgctgcgcatccgcgccgacgacccggacgcccgcgtgcctctgggcctgaagtacggcgctgaggtgtcggaggccgacgtgctgctgcgcacggcgaaggagctgggcctgcaggtggtgggcgtcagcttccacgttggcagcgcttgccagaacctgtccaccttctcgggcgccattgagaacgcgcgcaaggtgttcgacgaggccggcgccctgggcttcaacatggagctgctggatatcggcggtggcttcaccggccacttcgacgagatgggcaacgtgatgttcggcgagatcgcgaacaccatcaacgccgctctggccaccaacttcccgccggagatgggcgtgcgcgtcatcgccgagcccggccgctacttcgctgagaccagcagcacgctgctgacccccgtctacggccagcgcgaccgcgtggctgccgacggctccgtgaagaaggactactggctcaccgacggcctgtacggctccttcaactgcattctgtacgacggccagaaccctggctacaaggtcgtgcgctcgccgctgatggccgactcgaccgacagccgcaccttcctgtcgaccctgtggggtcccacctgcgacagcgctgactgcgtctacaaggacgtgaccctgcccgtgctgcgcaacggtgactggctgatgtggaacaacgccggcgcctacaccgtggccggtgcctgcgacttcaacggcatcgagttcaccactccgggcaagctgtacgtgtggtccgacagcgcggtggacgcggccgaggagggcgctgacgagcaggtcatgaacgcgtga

SEQ ID NO: 63 - protein, 396 aa, chlamydomonas reinhardtii
MEGIANSRWLLTLCVPFSPLPQAWRAAMPRVVPFYAVKCNPEPGILKLLNALGAGFDCASKGELDMMLRMGVSPNRIIFAHPCKRASDIRYAREHNVQYTTFDTVSELHKIAQMNPDFKCVLRIRADDPDARVPLGLKYGAEVSEADVLLRTAKELGLQVVGVSFHVGSACQNLSTFSGAIENARKVFDEAGALGFNMELLDIGGGFTGHFDEMGNVMFGEIANTINAALATNFPPEMGVRVIAEPGRYFAETSSTLLTPVYGQRDRVAADGSVKKDYWLTDGLYGSFNCILYDGQNPGYKVVRSPLMADSTDSRTFLSTLWGPTCDSADCVYKDVTLPVLRNGDWLMWNNAGAYTVAGACDFNGIEFTTPGKLYVWSDSAVDAAEEGADEQVMNA

SEQ ID NO: 64 - protein, 19 aa, Artificial sequence
  PS00878
  VARIANT (1)..(1): /replace = "Tyr"
  VARIANT (2)..(2): /replace = "Ala"
  UNSURE (3)..(3): Unknown amino acid
  VARIANT (5)..(5): /replace = "Ala" /replace = "Cys" /replace = "Val"
  VARIANT (6)..(6): /replace = "His" /replace = "Cys" /replace = "Leu" /replace = "Phe" /replace = "Trp"
  UNSURE (7)..(10): Unknown amino acid
  VARIANT (11)..(11): /replace = "Ile" /replace = "Val" /replace = "Met" /replace = "Phe"
  VARIANT (12)..(12): /replace = "Ile" /replace = "Val" /replace = "Met" /replace = "Thr" /replace = "Ala"
  UNSURE (13)..(14): Unknown amino acid
  VARIANT (15)..(15): /replace = "Ile" /replace = "Val" /replace = "Met" /replace = "Ala"
  UNSURE (16)..(18): Unknown amino acid
  VARIANT (19)..(19): /replace = "Thr" /replace = "Glu"
FPXKSNXXXXLLXXLXXXG

SEQ ID NO: 65 - protein, 18 aa, Artificial sequence
  PS00879
  VARIANT (1)..(1): /replace = "Ser" /replace = "Ala"
  UNSURE (2)..(3): Unknown amino acid
  UNSURE (4)..(7): Unknown amino acid or gap
  VARIANT (8)..(8): /replace = "Ile" /replace = "Val" /replace = "Met" /replace = "Ser" /replace = "Cys" /replace = "Pro"
  UNSURE (9)..(9): Unknown amino acid
  VARIANT (11)..(11): /replace = "Ile" /replace = "Val" /replace = "Met" /replace = "Phe"
  VARIANT (12)..(12): /replace = "Asn" /replace = "Ser"
  VARIANT (13)..(13): /replace = "Ile" /replace = "Val" /replace = "Met" /replace = "Cys" /replace = "Ala"
  VARIANT (17)..(17): /replace = "Ile" /replace = "Val" /replace = "Met" /replace = "Phe" /replace = "Tyr"
  VARIANT (18)..(18): /replace = "Ser" /replace = "Thr" /replace = "Pro" /replace = "Cys" /replace = "Glu" /replace = "Gln"
GXXXXXXLXNLDLGGGLG

SEQ ID NO: 66 - DNA, 1929 bp, Oryza sativa
atggctacttactactcgagccctggcaatgaaagggactcgcaagctatgtacccagcggattcaggcaattcatcatatcctgtgccatcagcaataggaaacatgttatatcctggcaatgggtcttctgggccatacacggaattcagtggcattatccagcatcagcagaatttcatggagctgcctggccatccaactgcgatctctcaagattcatcgtcacgggaacctaacatggtcgcgtcgtacatggatcagcgctcttttggacctgccaaagatatgagaaatgagatgttgatgcatctgatggatggagcacataatgctggtgctgatctcatccacaatgacactcatagcagcgcgcagattgagtttggcctattgaacaaccacaattcgatgagcgttgcaccagcaccaggccaaggattgtctctgagcctcaacacgcatatcctggcgccttcgtatccatactggtctgcgaaaacagagttgctaacaccacactcttaccatggtgatgacaacagaatgaagaatatgcaatctgaggcctcacaggcaatcagaaactcaaagtatctgaaagcagcacaagaattgcttgatgaggtcgtcagtgtttggaagagtataaagcagaaggctcagaaagaccaggctgaagcaggaaaatcagataacaaagaagccgaggggggttcgaaaggtgagggggtatcttccaacccacaggagtctactgccaatgctgcaccagagatttctgctgctgagaaacaagagctccagaataagatggcaaaacttatggccatgttggatgaggtggaccgaaagtacaaacactattatcatcaaatgcaaattgtagtctcatcttttgatatggttgctgggtctggagctgccaagccttatactgcagtggcccttcagacaatctcaaaacatttcagatgtctgaaagatgctatcaacgatcagatcaatgttatccggaagaaacttggagaggaggagagttcatctggcaaagagggaaaattaacgcgcctccgttatattgaccagcaattaagacaacagcgcgctttccagcagtatggtttgttacagcaaaatgcttggaggccacagaggggactgcccgaaaactcagtttcaattcttcgtgcttggctttttgaacacttccttcacccgtatccaaaagattcagaaaagctgatgctagcgagacaaactggcttaacaagaagtcagatttcaaattggttcataaatgcccgtgtccgcctgtggaaaccgatgatcgaagacatgtataaagaagagattggggaggcggatctcgactcgaactcctcctccgacaacgtaccaaggagcaaggacaaaatagcaacatctgaagataaggaagatctgaaaagctctatgagccagacttatcaaccaagccaattaggtgaatccaaagccaacatcgggatgatgagccttggtggggcaccagccggcttccacaacgaaggcacccaggatgacagcttcatgaacctaatgctgaaggaccaaaggccgggcgaagccgaaggcagcctcctccatgatgccgtcgcccatcattccgatgagaacgctcggttcatggcttaccatttgtcggggctcggaagatacgggaacagcaatgtgtcattgacacttggcttacagcatcctgacaacaggctttcggtacagaacactcatcagccaggtttcgccggtgctggagaagaaatttacaactccaccgcttctctcggtgtcgctgcagcttcctcttcggactacgaatccacgaaccaaatagatcaaaggcaacggttcgaaccatcgcctctaatgcatgattttgtggcctaa

SEQ ID NO: 67 - protein, 642 aa, Oryza sativa
MATYYSSPGNERDSQAMYPADSGNSSYPVPSAIGNMLYPGNGSSGPYTEFSGIIQHQQNFMELPGHPTAISQDSSSREPNMVASYMDQRSFGPAKDMRNEMLMHLMDGAHNAGADLIHNDTHSSAQIEFGLLNNHNSMSVAPAPGQGLSLSLNTHILAPSYPYWSAKTELLTPHSYHGDDNRMKNMQSEASQAIRNSKYLKAAQELLDEVVSVWKSIKQKAQKDQAEAGKSDNKEAEGGSKGEGVSSNPQESTANAAPEISAAEKQELQNKMAKLMAMLDEVDRKYKHYYHQMQIVVSSFDMVAGSGAAKPYTAVALQTISKHFRCLKDAINDQINVIRKKLGEEESSSGKEGKLTRLRYIDQQLRQQRAFQQYGLLQQNAWRPQRGLPENSVSILRAWLFEHFLHPYPKDSEKLMLARQTGLTRSQISNWFINARVRLWKPMIEDMYKEEIGEADLDSNSSSDNVPRSKDKIATSEDKEDLKSSMSQTYQPSQLGESKANIGMMSLGGAPAGFHNEGTQDDSFMNLMLKDQRPGEAEGSLLHDAVAHHSDENARFMAYHLSGLGRYGNSNVSLTLGLQHPDNRLSVQNTHQPGFAGAGEEIYNSTASLGVAAASSSDYESTNQIDQRQRFEPSPLMHDFVA

SEQ ID NO: 68 - DNA, 1944 bp, Oryza sativa
atggctacttactattcaagccctggtagcgaaagagactcgcagaccatgtactcaagagacccaggcagtgcatcctatcctatgtcatcagctctagggaacttgctctatctgaacaatccatcttctggaccttatacggagttcagcggcattctgcagcctcagcagaattgcatggagatgcctggccctgggcatgcgtcagcaatgtcacaagacccctcttcaagggagtccgacatgctttcttcgcaccagggtcaacgctctttcagccatgtcaaagatatgaaaaatgagatgttgatgcatatgatggatggagcacaaggtagtggctctgagctcatccatgatgatgcccacactggttcacagcttgagtttggtgttctgaataatcacaactcatcaagtgttccatcaatgcaaagccaagggctatctctgagcttgaacacacaaatcatggcgccttccttaccgtactggtctataaagccagacatgttaacgccgcagtcttaccatgacaaccttagaggggaagacatgcggatgaagaatttgcagtccgaagcttcacgcgcaatccggaactcaaggtatctcaaggcagcacaagaactgcttgatgaggtcgtgagtgtttggaagagcataaaacaaaaggctcagaaagagaaggttgaatcaggaaaagcagatggcaaagagactgatggagggccaaaaagtgagggtgtatcttctaatccacaagaatctggcgctaatgcagcacctgagctttccactgctgagaagcaagagcttcagaacaaaatggcaaaactgatggcaatgttggatgaggtggaccggaaatacaagcattattaccaccaaatgcaaaccgtggtttcatcgtttgatgtggtagctggaccaggatctgcgaagccttacacagcagttgctcttcagacaatctcacggcactttcggtgcctgaaggatgctatcaatgatcagatcaatgttatcaggaaaaagcttggcgaggaagagaactcatctggcaaggagggaaaattaacccgcctccggtacattgatcagcagctaaggcaacaacgtgctttccaacagtacggtatgattccacaaaacgcctggagaccacagaggggactgcctgaaaactctgttacaattcttcgcgcttggctgtttgaacacttcctccatccgtacccaaaagattccgagaagttaatgcttgctaggcagactggcctgactaggagtcagatttcgaattggttcataaatgcccgtgtccgcctttggaaaccaatgattgaagacatgtacaaagaagagattggtgatttagagcaagactccaactcttcctctgacaatgcaccaagaagtaaggataaaatggcatcttcagaagacaaggaggatctcaaaaactccagggcacggatttgcgaaacaagccaattgagcgagtcgagaaccagcattggagcaatgaatgttggcggagcgcctgttggcttccagaatgagcccaatcctgatgacagtttcatgaacctgatgctgaaggaccagcgatcgaacgaagtggatggcggcctccttctccacaacactgtcgcgcagcactcagacgagaacgcccggttcatggcctatcacttggcagagcttgggagatacggcaatggcaatgtgtcgctgacactgggcttgcagcactccagcagcaacctcgttcctaatgctcagccaggtttccctggtgttaatgaggatgacatctacaatgctactgctcctcttggtgtcaccgtcgcatcttcggactatgattcgatgaatcagatggatcaacggcaacggtttgagcattcacctcttctgcatgattttgtggcctga

SEQ ID NO: 69 - protein, 647 aa, Oryza sativa
MATYYSSPGSERDSQTMYSRDPGSASYPMSSALGNLLYLNNPSSGPYTEFSGILQPQQNCMEMPGPGHASAMSQDPSSRESDMLSSHQGQRSFSHVKDMKNEMLMHMMDGAQGSGSELIHDDAHTGSQLEFGVLNNHNSSSVPSMQSQGLSLSLNTQIMAPSLPYWSIKPDMLTPQSYHDNLRGEDMRMKNLQSEASRAIRNSRYLKAAQELLDEVVSVWKSIKQKAQKEKVESGKADGKETDGGPKSEGVSSNPQESGANAAPELSTAEKQELQNKMAKLMAMLDEVDRKYKHYYHQMQTVVSSFDVVAGPGSAKPYTAVALQTISRHFRCLKDAINDQINVIRKKLGEEENSSGKEGKLTRLRYIDQQLRQQRAFQQYGMIPQNAWRPQRGLPENSVTILRAWLFEHFLHPYPKDSEKLMLARQTGLTRSQISNWFINARVRLWKPMIEDMYKEEIGDLEQDSNSSSDNAPRSKDKMASSEDKEDLKNSRARICETSQLSESRTSIGAMNVGGAPVGFQNEPNPDDSFMNLMLKDQRSNEVDGGLLLHNTVAQHSDENARFMAYHLAELGRYGNGNVSLTLGLQHSSSNLVPNAQPGFPGVNEDDIYNATAPLGVTVASSDYDSMNQMDQRQRFEHSPLLHDFVA

SEQ ID NO: 70 - DNA, 1851 bp, Zea mays
atggctacttattactcgagccctggcagtgaaagagattcacaaacaatgtactcagcagagtcaggcaatgtatcatatcccgtgccatcagccctagggaactttctttatacgaacaatgcatcttctggaccttatacagaatttagtggaattgtccagcctcagcagaatttcatggaacttactggccatccttcagcaatgtcacatgattcgtcatccaatgaagctaccaacatgggcagttcactcactgaacagcgctcttttggtcctttgaaagatatgagaaatgagatgttgatgcatttgatggatggagcacacagcagtggcagtgatctcatccacaatgatgctcatagcactgtacagctcgaatttggcatgttaaacaaccacaactcaacaagtgttccattagcaccaggccaagggctgtctctgagcctcaatacacatatcttggcgccttcctatccacactggtctgcaaagcaagacttactaacaccaaattcttaccagggtgatgacaacagaatgaagaatatgcagtctgaggcctcacaggcaatccggaactctaagtatctgaaggcagcacaggagttacttgatgagattgtcagtgtttggaagtgtgttaaacagaaaacagataaaggccctgctgaagcaggaaaggctgatggaaaagagactgatggggggattaaaagtgagggggtatcttccaatccgcaagagtctggtgccaatgcagcagctgagctttcaactgctgagaaacaagagctccagaataagatggcaaaacttatgactatgttggacgaggtggataggaagtacaaacactattatcatcagatgcaacttgtaatgtcatcgtttaatatggttgctggtgctggagctgccaagccttatactgcagttgccctccagacaatctcacggcatttccgatgtctaaaggatgctatcaatgatcaaattagtgttatccggaagaaacttggagaggatgacaatacatccggcaaagagggcaaactaacccgccttcgttatattgatcagcaaataaggcaacagcgagctttccaacagtatggtatgctacagcaaaacgcttggaggccacagagaggactacctgaaaattcagtctcgattctccgggcttggctttttgaacacttccttcacccgtatccaaaagattctgaaaagctaatgttatcgagacaaactgggttgacaagaagtcagatttcaaactggttcatcaatgcccgtgtccggctgtggaagccaatgatcgaagacatgtacaaagaagagattggtgaggcggagctagactccaactcttcctccgacaacgggcagcgaaacaaggacaaagcaccatctcccgaagaaaatgaggacctgcagaccccaacaagccaggcttgccaaaccagccagctcggcgagtccaaagccatcgttggtggagtgatgggctttagtggagtgctagccggcggcttccacaccgaggccaaccccgacgacagcttcatgagcctgatgctgaaggcccagagacctggtgaaaccgaaggcaccggtctcctccacgatgccgtcgctcaccactccgacgacgagcgcccggttcatggcgtaccacctgacagagtttgggaggtatgggaacaacaacgtctcactgactctggggttgcagcacgccgagaacacccagccgggcttccccggcgtcagagaccaagacatctacaactccacagctcctctcaacgtcacctccacatcttcagagtatga

SEQ ID NO: 71 - protein, 616 aa, Zea mays
MATYYSSPGSERDSQTMYSAESGNVSYPVPSALGNFLYTNNASSGPYTEFSGIVQPQQNFMELTGHPSAMSHDSSSNEATNMGSSLTEQRSFGPLKDMRNEMLMHLMDGAHSSGSDLIHNDAHSTVQLEFGMLNNHNSTSVPLAPGQGLSLSLNTHILAPSYPHWSAKQDLLTPNSYQGDDNRMKNMQSEASQAIRNSKYLKAAQELLDEIVSVWKCVKQKTDKGPAEAGKADGKETDGGIKSEGVSSNPQESGANAAAELSTAEKQELQNKMAKLMTMLDEVDRKYKHYYHQMQLVMSSFNMVAGAGAAKPYTAVALQTISRHFRCLKDAINDQISVIRKKLGEDDNTSGKEGKLTRLRYIDQQIRQQRAFQQYGMLQQNAWRPQRGLPENSVSILRAWLFEHFLHPYPKDSEKLMLSRQTGLTRSQISNWFINARVRLWKPMIEDMYKEEIGEAELDSNSSSDNGQRNKDKAPSPEENEDLQTPTSQACQTSQLGESKAIVGGVMGFSGVLAGGFHTEANPDDSFMSLMLKAQRPGETEGTGLLHDAVAHHSDDERPVHGVPPDRVWEVWEQQRLTDSGVAARREHPAGLPRRQRPRHLQLHSSSQRHLHIFRV

SEQ ID NO: 72 - DNA, 1854 bp, Gymnadenia conopsea
atggctactttctatcccagttccactaaccgaagggatattatggcaaatctttatttgagagatacaggagggcattccatgtatcatgaaccagcagattctgacaatatagtctatcttaactactcatctggtccatattccgaagaatcccaacaaaatggcattgggtttaccgacttggttgcgtctcagcttggcgaaaattcttacagttcttggagggatgggaggaatgagatgctctttatgcaagaaaatgttggatcaatgaatggtggggatgaactcctttgcaattcggttactggtgatccccatatgggtattcagtcacagttgggtattttgaatgggcataacttgtctttgcagcactcgaacatttctaatgttcaaggtcaaggattgtctcttagtctcggctcgcagattccaattcatcctttcaagtatcagtctgctggatccgatgtctcagttttgaattcccatcactcgagccaaggaaattgtggtacatatagaaatgacgaatccagaattagatttccgaatgctagtatatggagttacggaggtacaaacatcagaagcaccattattcctaattccaagtaccttaagactgcccaacagttgcttgatgaggtggttaatgttcagaaggctttaaaaaagaagtctgatgataaccagagtgataacatttctagcaaacctacttgcaaagacaatgatgtggaatcgaagagtggcgggaacacattgaatcatgcaacaaattcttcgagtgaactatcatcttcagaaaggcaggatcttcagaacaaaatgacaaaacttctggctatgttggatgaggttgatcgaagatacaagcagtattaccatcaaatgcagatagttgcttcttcttttgacacaatagcaggttttggggctgcaaaaccttacacagctctcgccctccagacaatctcacggcactttaggagcctaagagatgctatcagcgatcggattcgatgcacaagaaaaatccttggcgagccagatgcctcagctggcaaaggatgcggaatttctcgtcttcgctacattgatcagcaaacaaggcaacagagggccatacaacagcttggtgtgatgccacggcatgcttggaggccacagagagggttgcctgagaactcagtcaccattcttcgagcttggctctttgagcactttcttcatccgtacccaagtgattctgaaaaacttgtgctatcaagacaaactggcttaaccagaagtcaggtttcaaattggttcatcaatgcacgcgttcgtctttggaagccgatggtcgaggatatgtacaaggaagagtttggtgagacggagatggactcgaactcttcctcagataatgcaaccaaatttagagacgaacttcactcaaacgacgcacaggaagaccagcgtaactcctcgaccgataaatatcatgcaaagcaatcaagctatgatcctggatatgaaactgatatgccgtgtgctgcttctggcttccagaatgagctacagggccatagaccgcaaagttcaacggacattgctcttctccaagacgccatccgccataccgacgagaattcgaggttcattggttatcagatgaatgagctcggcaggtacgcgaatggaggagtttcactcacgctcgggttacagcattgtgatagcaatattccaggttcagaaactcagcagcgctttgttcctatgaggggagaagatttatacaatggaggtccactgatggggtttggttcttcgaacacgatgcatgattttgttgcttga

SEQ ID NO: 73 - protein, 617 aa, Gymnadenia conopsea
MATFYPSSTNRRDIMANLYLRDTGGHSMYHEPADSDNIVYLNYSSGPYSEESQQNGIGFTDLVASQLGENSYSSWRDGRNEMLFMQENVGSMNGGDELLCNSVTGDPHMGIQSQLGILNGHNLSLQHSNISNVQGQGLSLSLGSQIPIHPFKYQSAGSDVSVLNSHHSSQGNCGTYRNDESRIRFPNASIWSYGGTNIRSTIIPNSKYLKTAQQLLDEVVNVQKALKKKSDDNQSDNISSKPTCKDNDVESKSGGNTLNHATNSSSELSSSERQDLQNKMTKLLAMLDEVDRRYKQYYHQMQIVASSFDTIAGFGAAKPYTALALQTISRHFRSLRDAISDRIRCTRKILGEPDASAGKGCGISRLRYIDQQTRQQRAIQQLGVMPRHAWRPQRGLPENSVTILRAWLFEHFLHPYPSDSEKLVLSRQTGLTRSQVSNWFINARVRLWKPMVEDMYKEEFGETEMDSNSSSDNATKFRDELHSNDAQEDQRNSSTDKYHAKQSSYDPGYETDMPCAASGFQNELQGHRPQSSTDIALLQDAIRHTDENSRFIGYQMNELGRYANGGVSLTLGLQHCDSNIPGSETQQRFVPMRGEDLYNGGPLMGFGSSNTMHDFVA

SEQ ID NO: 74 - DNA, 1938 bp, Solanum tuberosum
atggcgacttattttcctagtccaaacaatcaaagagatgctgatcagacatttcaatattttaggcaatctttgcctgagtcttattcagaagcttcaaatgctccagaaaacatgatggtattcatgaactattcttcttctggggcatattcagatatgttgacgggtacttcccaacaacaacacaactgcatcgatatcccatctataggagccacgcctttcaacacatcccaacaagaaatattgtcaaatcttggaggatcgcagatggggattcaggatttttcttcatggagagatagcagaaatgagatgctagctgataatgtctttcaagttgcacaaaatgtgcagggtcaaggattatccctcagtcttggctccaatataccatctggaattggaatttcacatgtccaatctcagaatcctaaccaaggtggcggttttaacatgtcctttggagatggtgataattcccaaccaaaagaacaaagaaatgcagattattttcctccggataatcctggaagggacttggatgctatgaaagggtataattctccatatggtacgtcgagtattgcaaggaccattcccagctcgaagtatttgaaagcagctcaatatttgcttgatgaggttgttagtgtcagaaaggccatcaaggagcaaaattctaagaaagagttgacaaaggattccagagagtctgatgtggactcgaaaaatatatcatcagatactcctgcaaatgggggttcaaatcctcatgagtccaaaaacaaccaaagtgaactttcacctaccgagaagcaagaagtgcagaacaaactggccaaacttctgtcaatgctggatgagattgatagaaggtacagacaatattatcatcagatgcaaatagtggtttcatcatttgatgtggtagctggagaaggagcagctaaaccatacacagctcttgctctccagacaatttcccgacacttccgttgcttgcgtgatgcaatctgcgatcagattcgagcatcacgaagaagtcttggagagcaagatgcttcagaaaacagcaaagcgattggaatatcacgcctgcgttttgtggatcatcatattagacagcagagagccctgcagcagcttggtatgatgcaacaacatgcctggaggcctcagaggggattgcctgaaagctctgtttcagttttgcgtgcttggctctttgagcactttcttcatccctacccgaaagattctgacaaaattatgctagcaaggcaaactggcttaacgagaagtcaggtatcaaattggttcataaatgcacgggtgcgtctttggaaacccatggttgaggaaatgtacaaagaagaggctggtgatgctaaaatagactcaaattcttcatcggatgttgcccccagacttgcaacaaaagactcaaaagttgaagaaagaggagaattgcaccagaatgcagcttcagaatttgagcagtacaatagtggccaaatcctggagtcaaaatctaaccatgaagctgatgtagaaatggagggagcaagtaatgcagaaactcaaagtcaatctggaatggaaaaccaaacaggcgaacccctgcctgctatggataattgcaccctttttcaggacgcatttgttcaaagcaacgatagattctcagaatttggtagttttggaagtggaaatgtactacccaatggagtttcacttacattggggctgcagcaaggtgaaggaagcaacctacctatgtccatcgaaactcacgttagttatgtaccattaagggcagatgacatgtatagtacagcacctactactatggtccctgaaacagcagaattcaactgcttggattctgggaataggcagcaaccattttggctcctaccatctgctacatga

SEQ ID NO: 75 - protein, 645 aa, Solanum tuberosum
MATYFPSPNNQRDADQTFQYFRQSLPESYSEASNAPENMMVFMNYSSSGAYSDMLTGTSQQQHNCIDIPSIGATPFNTSQQEILSNLGGSQMGIQDFSSWRDSRNEMLADNVFQVAQNVQGQGLSLSLGSNIPSGIGISHVQSQNPNQGGGFNMSFGDGDNSQPKEQRNADYFPPDNPGRDLDAMKGYNSPYGTSSIARTIPSSKYLKAAQYLLDEVVSVRKAIKEQNSKKELTKDSRESDVDSKNISSDTPANGGSNPHESKNNQSELSPTEKQEVQNKLAKLLSMLDEIDRRYRQYYHQMQIVVSSFDVVAGEGAAKPYTALALQTISRHFRCLRDAICDQIRASRRSLGEQDASENSKAIGISRLRFVDHHIRQQRALQQLGMMQQHAWRPQRGLPESSVSVLRAWLFEHFLHPYPKDSDKIMLARQTGLTRSQVSNWFINARVRLWKPMVEEMYKEEAGDAKIDSNSSSDVAPRLATKDSKVEERGELHQNAASEFEQYNSGQILESKSNHEADVEMEGASNAETQSQSGMENQTGEPLPAMDNCTLFQDAFVQSNDRFSEFGSFGSGNVLPNGVSLTLGLQQGEGSNLPMSIETHVSYVPLRADDMYSTAPTTMVPETAEFNCLDSGNRQQPFWLLPSAT

SEQ ID NO: 76 - DNA, 2076 bp, Vitis vinifera
atggctacatattaccctagttcaaataatcaaagagatgctgcccctatgcattatttaagggaacctttgcccacatcatattcggaagttcctgttcttcccactaatatgatgtatatgagctacccatcgtcttctgggtcatactcggacrcattggctgggaatgcccagcagcacaaccacaactgcattgaaattccatctgtggcagcttccgactccacccaaccgcagcatgaaatcttgtcaagccttagtgggtcacatatagtggaacatgatttcagcgcatggagggatggtaaaaatgagatgctagttatgaactcactgggtggccctgcaagccttcttcacaccgggcagcatttgcaggctcagggcttgtcccttagtcttggcacacaaatcccctcaggaatccaaattccttccattcaatatcggaatcccaatcagggtttcacctcattcttgagtcctacttcatcagtgtcgggtgaaggtggtggcaggagtggctcttctagggatgaacagttgagaaatgctgaatttttgccaccaggtgttcttggagctaatcaagattcaattaaaggggatccatcttcatatggaatgtcaagtattgcgaggaccattccccattccaagtacttaaaggcagcccagcaactgcttgatgaagttgttaatgttcgaaaagctttgaagcagcctgattctgagaaaaaccaaaacatacatgagctttggaagggttccaaagaggccgatgtgggtttgaagaatggaactggtatgactcctgcagcttcaaaccctcaagagcctgtcagcaattcctcaagtgagctttctcctgctgaaagacaggatttacaaaacaagttgacaaagcttttggccatgttagatgaggttgatagaaggtacaaacagtattatcaccagatgcagattgtggtatcatcatttgatgtgatagcaggatctggggctgcaaaaccctacacagcacttgccctccagacaatttctcgccacttccgctgcttgcgtgatgcaatcactggccagattcgagcaacgcgaagaagycttggggagcaagatacttcaggaaacggcaaaggggttggaatatctcgcctgcgatatgtggaccagcagctcaggcaacagagggctcttcagcagcttggtatgatgcaacaacatgcctggaggccacagagggggctgcctgaaagytctgtttctattcttcgtgcttggctatttgagcacttccttcatccctacccaaaagattctgataagatcatgctggcaaggcagacaggcttgaccaggagtcaggtctcaaactggtttataaatgcgcgggtgcgtctctggaagcccatggtggaagagatgtacaaagaagagataggtgatgcagatatggactctaattcttcgtccgaaaatgcacccaaagcgacaaaaagtgatatcagggcatctgaggaaagaggtgatgattttcagccaagcacaacttccacggyaaccgagagatgcagcactggccgatttcttgactccaaatccagtaatgctcccgatgtagagatggggggaccaactgyaggagccagtttcagaaatggggaacggggtgaaacccaaactgaatatggaatagtgaaattaagcggggaccaaaggcctagcgtggaggaatgcagcagcctcttcccagatggcattgttcagtctgatgggggcagcgataggttcatggcagccgctgctgcagcataccacatgtcagagttggggaggttcggaagtggaactggggtatctcttacattggggttgcagcattgcgagggaggcagcttacccatttccaatggaggtcatcacagttttgtgggtatgcggggggccgatatgtacaacccagcagcttcttcagtggggactgacacggccgatttygactgcatggatcctggcaaccggcagcacagattcagctcctcccatctattacatgattttgtagcctga

SEQ ID NO: 77 - protein, 691 aa, Vitis vinifera
  UNSURE (53)..(53): Unknown amino acid
  UNSURE (522)..(522): Unknown amino acid
  UNSURE (549)..(549): Unknown amino acid
MATYYPSSNNQRDAAPMHYLREPLPTSYSEVPVLPTNMMYMSYPSSSGSYSDXLAGNAQQHNHNCIEIPSVAASDSTQPQHEILSSLSGSHIVEHDFSAWRDGKNEMLVMNSLGGPASLLHTGQHLQAQGLSLSLGTQIPSGIQIPSIQYRNPNQGFTSFLSPTSSVSGEGGGRSGSSRDEQLRNAEFLPPGVLGANQDSIKGDPSSYGMSSIARTIPHSKYLKAAQQLLDEVVNVRKALKQPDSEKNQNIHELWKGSKEADVGLKNGTGMTPAASNPQEPVSNSSSELSPAERQDLQNKLTKLLAMLDEVDRRYKQYYHQMQIVVSSFDVIAGSGAAKPYTALALQTISRHFRCLRDAITGQIRATRRSLGEQDTSGNGKGVGISRLRYVDQQLRQQRALQQLGMMQQHAWRPQRGLPESSVSILRAWLFEHFLHPYPKDSDKIMLARQTGLTRSQVSNWFINARVRLWKPMVEEMYKEEIGDADMDSNSSSENAPKATKSDIRASEERGDDFQPSTTSTXTERCSTGRFLDSKSSNAPDVEMGGPTXGASFRNGERGETQTEYGIVKLSGDQRPSVEECSSLFPDGIVQSDGGSDRFMAAAAAAYHMSELGRFGSGTGVSLTLGLQHCEGGSLPISNGGHHSFVGMRGADMYNPAASSVGTDTADFDCMDPGNRQHRFSSSHLLHDFVA

SEQ ID NO: 78 - DNA, 1884 bp, Medicago truncatula
atgtatccgaaccaagcgttttcttcgggatcttacgccgagatgatttctgggaatactttgttacctcataattacagtgaatctgtaggaggacaaaatgagttgaagtttatgacatctatggatgatacaatgaatatgctgtctattgatcaggggcattccaatgctactacgagcgatccaaggacacaattcggactcgttgagagcgagcaaaatgtacaatgccaaggcctgtctcttagccttgggacaatgatgccttcctttcaatatcagtatcccggcaacagtttcacctcactaatgaatgctcaaatttcaaacttgaaggggtctgcatctcttaaggatgatgaggctgagtgcatggcatctttgtcttctggaggatttcaaaacaatgtcaaaagggagggtttgtataatccacatccttcaataggccttaatgaaggccaatctgatccgtgcctgcaaggatcagcagttattccgaacaatgcccttaactctcactaccttaaggcagcacaggaacttcttgatgaaatagttaatgtccgaaagggcttgaaacaaaccggattggaaaaacaacaaagttttcacgatgctggtttagatgcttccaaagattctgatggaaaatctacaagtcaatctatgcaagtatcttcaggccctaatggttctaatgcaaacaactcttcatgtgagctatctcccgcggaacgacagcatttattggacaagaaaacaaaacttttgtccatgttggatgagttagacaaaagataccgacaatactgtcatcaaatgcagattgttgtgtcatcttttgacatggttgctggttgcggcgcagccgaaccatacactgctcttgctttgcgcaccatttctcgtcactttcgctgtttgcgtgatgctattagcggccaaattcagttgactcaaaggagccttggtgaacaagagggaatacctcgtctccgctatgttgatcaacagcttagacaacaaaaagctcttcagcagcttggtgtaatgagacaagcttggagacctcagagaggacttcctgaaagctctgtgtcaatactccgtgcgtggctctttgagcatttccttcatccttatccaaaggattcagagaaaatcatgttggcaagacaaacaggcttgaccagaaaccaggtggcgaattggttcattaatgcgagggtgcgtctttggaaaccaatggtcgaagaaatgtacaaagaagagtttggtgattcggagacaagcagcaatcttttatcagaaaacacgccaaaagctccgagagacgatgatgttcgagtgtgggatgataaaagggaagagtctcatgacaagttaatgaatgttgatggtgctcaacaacaaggtcaaattgcagggttgaagttagatcatgcatcctcctcaaccacagaattggatagagggattcaaagtagcgatcattggactaatgtgatggattctagaattgggaaaatgcaaggtgaccaacaaaggtttaacatgaacaatagtccttattcaaatccacctatctcaatcaaccaaaatggtgatggctgcataatggattctactcctacaacttatgatgatttatcagagttgaataactttggtgttggtggccatgtctcacttgcattggagttgaggaactctgaaagtgatggatttggtttgtccaatgatgacatcaataaaaggcgtaatcaagcaatggcttcttcacctgatactgatttgttagactatcacttcacagacactggaaagcaacaacacaagtttgccaaccctcatttgttacatgagtttgttgtctga

SEQ ID NO: 79 - protein, 627 aa, Medicago truncatula
MYPNQAFSSGSYAEMISGNTLLPHNYSESVGGQNELKFMTSMDDTMNMLSIDQGHSNATTSDPRTQFGLVESEQNVQCQGLSLSLGTMMPSFQYQYPGNSFTSLMNAQISNLKGSASLKDDEAECMASLSSGGFQNNVKREGLYNPHPSIGLNEGQSDPCLQGSAVIPNNALNSHYLKAAQELLDEIVNVRKGLKQTGLEKQQSFHDAGLDASKDSDGKSTSQSMQVSSGPNGSNANNSSCELSPAERQHLLDKKTKLLSMLDELDKRYRQYCHQMQIVVSSFDMVAGCGAAEPYTALALRTISRHFRCLRDAISGQIQLTQRSLGEQEGIPRLRYVDQQLRQQKALQQLGVMRQAWRPQRGLPESSVSILRAWLFEHFLHPYPKDSEKIMLARQTGLTRNQVANWFINARVRLWKPMVEEMYKEEFGDSETSSNLLSENTPKAPRDDDVRVWDDKREESHDKLMNVDGAQQQGQIAGLKLDHASSSTTELDRGIQSSDHWTNVMDSRIGKMQGDQQRFNMNNSPYSNPPISINQNGDGCIMDSTPTTYDDLSELNNFGVGGHVSLALELRNSESDGFGLSNDDINKRRNQAMASSPDTDLLDYHFTDTGKQQHKFANPHLLHEFVV

SEQ ID NO: 80 - DNA, 2043 bp, Arabidopsis thaliana
atggctgcttactttcacggaaacccaccggagatctctgccggatccgacggtggtcttcaaacgttgatcctcatgaatccaactacttacgttcagtacacccaacaagacaacgactcgaacaacaacaacaacagcaacaatagcaacaacaacaacacaaacacaaacacaaacaacaacaacagtagtttcgttttcctcgattcccacgcgccgcagccaaacgcgagccagcagttcgtcggaataccactctcaggtcacgaagctgcttccattacagccgccgacaacatctccgtacttcacggttatcctccgcgcgtgcagtacagtctctacggtagccaccaagtggatcccactcaccagcaagccgcgtgtgagacgccacgcgcgcagcaaggcctctctttaaccctctcgtctcaacagcagcagcaacagcaacatcatcaacaacaccagcctattcacgtcggattcgggtccggacatggagaagatatccgggtcgggtctggctctacaggatcgggggtaacaaacggtatagctaatcttgttagctccaagtacttgaaggcagcacaagagcttcttgacgaagtagtcaacgctgattccgatgacatgaacgctaaatcccaactattctcatcgaaaaagggtagttgcggaaatgataaacctgtcggagaatcatcggccggcgctggaggagaaggttccggtggcggagcagaagcagccgggaaacgtccggtggagctaggcacggcagagagacaagaaatacagatgaagaaagcaaaacttagtaacatgcttcatgaggtggagcagagatatagacagtaccaccagcagatgcagatggtgatctcttcgttcgagcaagcggcagggataggatcagcgaagtcatacacgtcgctagcattgaaaaccatatcaagacagttccgttgcttgaaagaggcgatcgctggtcagataaaagcggccaacaagagtcttggggaggaagattcagtgtctggtgttgggaggtttgaggggtcgaggctcaagttcgtggaccaccacttgagacagcaaagagctcttcaacaactgggaatgattcaacatccttccaataatgcttggagacctcaacgtggtctcccagaacgagccgtctcagttctccgtgcttggctcttcgaacactttcttcatccataccctaaggattcggacaagcacatgctagctaagcaaacaggactcactcgtagccaggtgtcgaactggtttataaacgcgagagttcggttatggaaaccaatggtggaggagatgtacatggaggaaatgaaggagcaggcaaagaacatgggatccatggaaaagactcctttggatcaaagcaacgaagattctgcttcaaagtcaacaagtaaccaagaaaagagcccaatggcggacactaattaccatatgaatcccaatcacaacggtgacctagaaggcgtcactggaatgcaaggaagccccaagagactaagaaccagcgacgagacaatgatgcagccaataaatgcggatttcagctccaacgagaagctcacgatgaagattctagaagaacggcaagggataagatcagatggtggctaccctttcatgggtaatttcgggcaataccaaatggatgagatgtcaagatttgatgtagtctcagaccaggagctcatggcgcaaaggtactcaggaaacaacaatggcgtgtccctcacgttaggtttacctcattgtgatagcttgtcgtccacgcaccatcagggtttcatgcagacccaccatgggattcctatagggagaagagtgaaaataggagaaacagaggaatatggacccgccaccatcaatggtggtagctcgaccacaaccgcacattcatcagcggcagctgccgcggcttacaatgggatgaacatacagaaccagaagagatatgtggctcagttattgcccgacttcgttgcataa

SEQ ID NO: 81 - protein, 680 aa, Arabidopsis thaliana
MAAYFHGNPPEISAGSDGGLQTLILMNPTTYVQYTQQDNDSNNNNNSNNSNNNNTNTNTNNNNSSFVFLDSHAPQPNASQQFVGIPLSGHEAASITAADNISVLHGYPPRVQYSLYGSHQVDPTHQQAACETPRAQQGLSLTLSSQQQQQQQHHQQHQPIHVGFGSGHGEDIRVGSGSTGSGVTNGIANLVSSKYLKAAQELLDEVVNADSDDMNAKSQLFSSKKGSCGNDKPVGESSAGAGGEGSGGGAEAAGKRPVELGTAERQEIQMKKAKLSNMLHEVEQRYRQYHQQMQMVISSFEQAAGIGSAKSYTSLALKTISRQFRCLKEAIAGQIKAANKSLGEEDSVSGVGRFEGSRLKFVDHHLRQQRALQQLGMIQHPSNNAWRPQRGLPERAVSVLRAWLFEHFLHPYPKDSDKHMLAKQTGLTRSQVSNWFINARVRLWKPMVEEMYMEEMKEQAKNMGSMEKTPLDQSNEDSASKSTSNQEKSPMADTNYHMNPNHNGDLEGVTGMQGSPKRLRTSDETMMQPINADFSSNEKLTMKILEERQGIRSDGGYPFMGNFGQYQMDEMSRFDVVSDQELMAQRYSGNNNGVSLTLGLPHCDSLSSTHHQGFMQTHHGIPIGRRVKIGETEEYGPATINGGSSTTTAHSSAAAAAAYNGMNIQNQKRYVAQLLPDFVA

SEQ ID NO: 82 - DNA, 1603 bp, Arabidopsis thaliana
atggagaattatccagaaacacagtttattcccggagattcaatgatccagaatgctatagtttcttactctgaggaatcagccggtagagaaagaagaactgaagctaacaatgtctcagcctcacaagagaggcaagcattgtccagatttgggggagttccacaaatgcagaacattggtcaagatttcggttcttggagagatcaagcgagtgacaggaacggtttccagctaatgagcgcgatggcaggtgccacggggattcttcagaccggtcagggactgtcccttagccttggttcacagattcttccaggaattcatcagataagccatcaaaatatggcgccgagaggcaatgagtatgcaacacagagttttccgggcgggaatcagaacttggatgttgtgagaacaattcccaactcaaagtatcttaaggcggctcaacagcttctagatgaggctgttaatgtaaagaaagctctaaagcagtttcaggcagagggagataaaaacaatgagaaccctcaagaaccgaatcagagcactcaagactcgagcacgaatcctcctgcggacatctctcagtcggagagacaagaaatgcagagcaagttgacaaaactcttgtcaatgttggatgaggtggatagaagatataagcaatattaccagcagatgcagatagttgtatcctcgttcgatgtgatagctggttatggagcagctaagccatacacagcactcgcccttcaaacaatttctcgccattttcgtagcctaagggatgcgatatccggacaaatcctcgtgctacgtaaatgccttggggaacaacaagatggatcagatgggaaaagagttgggattataagccggcttaagtacgttgatcaacatttaagacaacaaagaggttttatgcaacctcaagcttggagacctcaacgcggtctacctgaaaactctgttttgattctccgtgcttggctctttgagcattttcttcacccttacccaaaggattctgataagatcatgctagcaagacaaacgggcttgagccgcggtcaggtttcaaactggttcataaatgcacgagtgcgtttatggaagccaatggtggaggagatatacaaggaggaattcacagagaatgattccaactcgtcttccgaaaatacaccgaaaatgtctgagataggacctgttgctgctgatgatgaagatcgagctcgagagttttcacaagaccagaccaaaccggaccatggacatggatatggcgaggaaactcgtggcatggtccaaggcagtcatatggatggtcgccggttcatggcagttgagcctacatatcatgtggctgatacgtcaagattgggtcgtggtgatgtgtccttgactctagggcttcaaaactctcaaggacaggacaatgttgtggctatgtctagtgaggcatacaacaacttttccggggtggatatttacgagaatgccatcccgggagatgaaatggagtatgtaaaccccggaagtcgccagaaccggataaattcttcacaattggtacatgattttgtagcttgaagaa

SEQ ID NO: 83 - protein, 532 aa, Arabidopsis thaliana
MENYPETQFIPGDSMIQNAIVSYSEESAGRERRTEANNVSASQERQALSRFGGVPQMQNIGQDFGSWRDQASDRNGFQLMSAMAGATGILQTGQGLSLSLGSQILPGIHQISHQNMAPRGNEYATQSFPGGNQNLDVVRTIPNSKYLKAAQQLLDEAVNVKKALKQFQAEGDKNNENPQEPNQSTQDSSTNPPADISQSERQEMQSKLTKLLSMLDEVDRRYKQYYQQMQIVVSSFDVIAGYGAAKPYTALALQTISRHFRSLRDAISGQILVLRKCLGEQQDGSDGKRVGIISRLKYVDQHLRQQRGFMQPQAWRPQRGLPENSVLILRAWLFEHFLHPYPKDSDKIMLARQTGLSRGQVSNWFINARVRLWKPMVEEIYKEEFTENDSNSSSENTPKMSEIGPVAADDEDRAREFSQDQTKPDHGHGYGEETRGMVQGSHMDGRRFMAVEPTYHVADTSRLGRGDVSLTLGLQNSQGQDNVVAMSSEAYNNFSGVDIYENAIPGDEMEYVNPGSRQNRINSSQLVHDFVA

SEQ ID NO: 84 - DNA, 1827 bp, Oryza sative
gcttgagtcatagggagaaaacaaatcgatcatatttgactcttttccctccatctctcttaccggcaaaaaaagtagtactggtttatatgtaaagtaagattctttaattatgtgagatccggcttaatgcttttcttttgtcacatatactgcattgcaacaattgccatatattcacttctgccatcccattatatagcaactcaagaatggattgatatatcccctattactaatctagacatgttaaggctgagttgggcagtccatcttcccaacccaccaccttcgtttttcgcgcacatacttttcaaactactaaatggtgtgttttttaaaaatattttcaatacaaaagttgctttaaaaaattatattgatccatttttttaaaaaaaatagctaatacttaattaatcacgtgttaaaagaccgctccgttttgcgtgcaggagggataggttcacatcctgcattaccgaacacagcctaaatcttgttgtctagattcgtagtactggatatattaaatcatgttctaagttactatatactgagatgaatagaataagtaaaattagacccaccttaagtcttgatgaagttactactagctgcgtttgggaggacttcccaaaaaaaaaagtattagccattagcacgtgattaattaagtactagtttaaaaaacttaaaaaataaattaatatgattctcttaagtaactctcctatagaaaacttttacaaaattacaccgtttaatagtttggaaaatatgtcagtaaaaaataagagagtagaagttatgaaagttagaaaaagaattgttttagtagtatacagttataaactattccctctgttctaaaacataagggattatggatggattcgacatgtaccagtaccatgaatcgaatccagacaagttttttatgcatatttattctactataatatatcacatctgctctaaatatcttatatttcgaggtggagactgtcgctatgtttttctgcccgttgctaagcacacgccacccccgatgcggggacgcctctggccttcttgccacgataattgaatggaacttccacattcagattcgataggtgaccgtcgactccaagtgctttgcacaaaacaactccggcctcccggccaccagtcacacgactcacggcactaccacccctgactccctgaggcggacctgccactgttctgcatgcgaagctatctaaaattctgaagcaaagaaagcacagcacatgctccgggacacgcgccacccggcggaaaagggctcggtgtggcgatctcacagccgcatatcgcatttcacaagccgcccatctccaccggcttcacgaggctcatcgcggcacgaccgcgcacggaacgcacgcggccgacccgcgcgcctcgatgcgcgagcccatccgccgcgtcctccctttgcctttgccgctatcctctcggtcgtatcccgtttctctgtcttttgctccccggcgcgcgccagttcggagtaccagcgaaacccggacacctggtacacctccgccggccacaacgcgtgtccccctacgtggccgcgcagcacatgcccatgcgcgacacgtgcacctcctcatccaaactctcaagtctcaacggtcctataaatgcacggatagcctcaagctgctcgtcacaaggcaagaggcaagaggcaagagcatccgtattaaccagccttttgagacttgagagtgtgtgtgactcgatccagcgtagtttcagttcgtgtgttggtgagtgattccagccaagtttgcg

SEQ ID NO: 85 - DNA, 659 bp, Oryza sative
gctaagtgagctagccactgatcagaagaacacctcgatctctgagagtgttttttcagctttagcttaagcaggatggagcaccaggggcagcacggccacgtgaccagccgcgtcgacgagtacggcaacccggtcggcaccggcgccggacacggccagatgggcaccgccggcatggggacgcacggcaccgccggcaccggcggcggccagttccagccgatgagggaggagcacaagaccggcggcgtcctgcaacgctccggcagctccagctcaagctcgtctgaggatgatggaatgggagggaggaggaagaaggggatcaaggagaagatcaaggagaagctccccggcggcaacaagggcgagcagcagcatgccatgggcggcaccggcaccggcaccggcaccggcaccggaaccggcggcgcctacgggcagcagggccacggcaccgggatgaccaccggcaccaccggcgcacacggcaccaccaccaccgacaccggcgagaagaagggcatcatggacaagatcaaggagaagctgcccggccagcactgagctcgacacaccaccacaccatgtgtctgcgcccccggcgaccgccgccacgtcaccttcctgaataataagatgagctaaccgagcgc

SEQ ID NO: 86 - DNA, 55 bp, Artificial sequence
  primer: prm08627
ggggacaagtttgtacaaaaaagcaggcttaaacaatggctacttactactcgag

SEQ ID NO: 87 - DNA, 46 bp, Artificial sequence
  primer: prm08628
ggggaccactttgtacaagaaagctgggtttaggccacaaaatcat

SEQ ID NO: 88 - DNA, 972 bp, Arabidopsis thaliana
atggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagcaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaagtctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctga

SEQ ID NO: 89 - protein, 323 aa, Arabidopsis thaliana
MVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKLNKVNQDSHQELDRSSLSSSPSSSSANSNSNISRGQWERRLQTDIHLAKKSLSEALSPAVAPIITSTVTTTSSSAESRRSTSSASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEKWLFEDSGGQIGDILLDENTNFF

SEQ ID NO: 90 - DNA, 972 bp, Arabidopsis thaliana
atggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagcaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctga

SEQ ID NO: 91 - protein, 323 aa, Arabidopsis thaliana
MVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKLNKVNQDSHQELDRSSLSSSPSSSSANSNSNISRGQWERRLQTDIHLAKKALSEALSPAVAPIITSTVTTTSSSAESRRSTSSASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEKWLFEDSGGQIGDILLDENTNFF

SEQ ID NO: 92 - DNA, 843 bp, Arabidopsis thaliana
atgggtaggcctccatgctgtgacaagatagggatcaagaaaggaccatggactcctgaagaagatatcattcttgtttcttacattcaagaacatggtcctggaaactggagatcagttcccaccaacactgggttattgagatgcagcaaaagttgtagactgagatggacaaattatctgagacctggaattaaacgtggaaactttactcctcatgaagaaggaatgatcattcacttgcaagccttattgggtaacaaatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcaccgaaaacatttcccgccttcttgagggttggatgagagcgtctccaaagagtagtacaagtactactttcttggaacacaaaatgcagaaccggacaaacaatttcatcgatcatcacagcgatcagtttccatacgagcagcttcaaggttcttgggaagagggtcatagcaaaggaatcaacggggatgatgaccagggtataaagaattcagagaataacaacggtgatgatgttcatcatgaagatggtgatcatgaggatgatgatgatcataatgctacaccaccattgacatttattgagaaatggcttttggaggaaacaagtactactgggggtcaaatggaagagatgagccacttgatggagctctctaatatgctttaa

SEQ ID NO: 93 - protein, 280 aa, Arabidopsis thaliana
MGRPPCCDKIGIKKGPWTPEEDIILVSYIQEHGPGNWRSVPTNTGLLRCSKSCRLRWTNYLRPGIKRGNFTPHEEGMIIHLQALLGNKWASIASYLPQRTDNDIKNYWNTHLKKKLNKSDSDERSRSENIALQTSSTRNTINHRSTYASSTENISRLLEGWMRASPKSSTSTTFLEHKMQNRTNNFIDHHSDQFPYEQLQGSWEEGHSKGINGDDDQGIKNSENNNGDDVHHEDGDHEDDDDHNATPPLTFIEKWLLEETSTTGGQMEEMSHLMELSNML

SEQ ID NO: 94 - DNA, 993 bp, Arabidopsis thaliana
atgggtagaccaccttgttgcgagaagattgaggtgaagaaaggaccatggactcccgaagaagacataatcttggtctcttatatccaacaacacggccctggaaattggagatctgtccctgcaaacaccggtttgctaaggtgtagcaagagttgcagacttagatggactaattaccttcgtcccgggatcaaacgaggaaatttcactcaaccggaagagaagatgatcatccaccttcaagctcttttgggaaatagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactgatgatcaaggctcgttgtcattgatcgagaaatggttgtttgatgatcaaggcttggttcagtgtgatgatagtcaagaagatctcatcgacgtgtctttagaggagttaaaataa

SEQ ID NO: 95 - protein, 330 aa, Arabidopsis thaliana
MGRPPCCEKIEVKKGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKLVMMKFQNGIINENKTNLATDISSCNNNNNGCNHNKRTTNKGQWEKKLQTDINMAKQALFQALSLDQPSSLIPPDPDSPKPHHHSTTTYASSTDNISKLLQNWTSSSSSKPNTSSVSNNRSSSPGEGGLFDHHSLFSSNSESGSVDEKLNLMSETSMFKGESKPDIDMEATPTTTTTDDQGSLSLIEKWLFDDQGLVQCDDSQEDLIDVSLEELK

SEQ ID NO: 96 - DNA, 1002 bp, Arabidopsis thaliana
atgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctag

SEQ ID NO: 97 - protein, 333 aa, Arabidopsis thaliana
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 98 - DNA, 1056 bp, Arabidopsis thaliana
atgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctag

SEQ ID NO: 99 - protein, 351 aa, Arabidopsis thaliana
MGRPPCCEKIGVKKGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKLKKINESGEEDNDGVSSSNTSSQKNHQSTNKGQWERRLQTDINMAKQALCEALSLDKPSSTLSSSSSLPTPVITQQNIRNFSSALLDRCYDPSSSSSSTTTTTTSNTTNPYPSGVYASSAENIARLLQDFMKDTPKALTLSSSSPVSETGPLTAAVSEEGGEGFEQSFFSFNSMDETQNLTQETSFFHDQVIKPEITMDQDHGLISQGSLSLFEKWLFDEQSHEMVGMALAGQEGMF

SEQ ID NO: 100 - DNA, 924 bp, Oryza sativa
atggggcggccgccgtgttgcgagaaggagggggtgaagaaggggccatggacgccggaggaggacatggtgctggcgtcgtacgtgcaggagcacggcccgggcaactggcgcgccgtgccgcccaggacgggcctcctccgctgcagcaagagctgccgcctccgctggaccaactacctccgcccgggcatccgccgcggcggcttctcccaccacgaggagcgcctcatcctccacctccaggccctcctcggcaaccgctgggccgccatcgcctcctacctcccccaccgcaccgacaacgacgtcaagaacttctggaacacccacctcaagaagaagctcgccctcacctcctcctcctcctcgccgccgacgccgacgacgccgctcgtcgccagggggcagtgggagcgcaagctgcagaccgacatcgacctcgccaggcgcgccctccgcgacgccctctccgtcgacgacgccgcctccccggcgatgatcagcagcgggccgcccgcgccggcggcggcggcggcgtacgccctgagcgagcgcaacatctccgtgatgctgagcggctgggcggcgccgcctccggccaggaaaggattgtcagcctgcaacccggcggcggcgacgacgacgcccggtggcgccgccgcggagagcgcgtccacggccgggacgtcgttggagctcaccgccgactgctgctccggcggcggcgactccagcgcgtccaactgcctgccgtcgtccatgctcctcgcgtgcgacgacggcgacgcgacggcgacggcggccggggtggcgccgctgtcggcgatcgagtcgtggctgctgctcgacgacagcggagagccgcagctggcactggacgagcagctgctggacgtagctctccgtaattacgctttctaa

SEQ ID NO: 101 - protein, 307 aa, Oryza sativa
MGRPPCCEKEGVKKGPWTPEEDMVLASYVQEHGPGNWRAVPPRTGLLRCSKSCRLRWTNYLRPGIRRGGFSHHEERLILHLQALLGNRWAAIASYLPHRTDNDVKNFWNTHLKKKLALTSSSSSPPTPTTPLVARGQWERKLQTDIDLARRALRDALSVDDAASPAMISSGPPAPAAAAAYALSERNISVMLSGWAAPPPARKGLSACNPAAATTTPGGAAAESASTAGTSLELTADCCSGGGDSSASNCLPSSMLLACDDGDATATAAGVAPLSAIESWLLLDDSGEPQLALDEQLLDVALRNYAF

SEQ ID NO: 102 - DNA, 1025 bp, Oryza sativa
tggtgaggccgccgtgctgcgacaaggacggcgtcaagaagggcccgtggacgccggaggaggacctcgtcctcgtctcctacgtccaggagcacggccccggcaactggcgcgccgtcccgaccagaacagggctgatgcggtgcagcaagagctgtaggctccggtggaccaactacctgaggcccgggatcaagcggggaaacttcaccgaccaggaggagaagctcatcgtccacctccaggcgctcctcggcaaccgctgggcggccatcgcgtcgtacctccccgagcgcacggacaacgacatcaagaactactggaacacccacctcaagcgcaagctgcagggcggcggcgccggcggtgacggagacggtggcgccgccggcgacgcggtctccccgaagcccgccgcgcagaggcccgcgtcgtcgtccaaggggcagtgggagcggcgcctgcagaccgacatcgacatggcgcgccgcgcgctccgcgaggcgctcacgtcgctcgacgacgtcaagccaccgcatcagcccgacgccgccaacgccgccgcggggggaggcggcgccaccaccggagcagcagcgtccgccggcgccgatagccccgccgcgtcgagcacgtcgggggcgtcgcagtgctccccgtcatccgccggctacgtcctcaccaccgagaacatctcccggatgctcgacgggtgggcccggaagaagggcggcggcggcggcaggcgcgccgccggcagcgggccggccacccccggcgccaccgagagcgcgtccggctcgtcggaagcctccgaggtgtcctacggcggcacggccttgtccgcagcggcggcgcccgcgtccgccttcgagtacgagacaaagccgaccgtcaccgccgccgccgccgccgacgccggcgacgagacgcagctctccgccatcgagtcgtggctgttcgccgacgccgacggcatcgagagtggcagcttgctcgacgcggccatggattacaccttctaa

SEQ ID NO: 103 - protein, 341 aa, Oryza sativa
MVRPPCCDKDGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQGGGAGGDGDGGAAGDAVSPKPAAQRPASSSKGQWERRLQTDIDMARRALREALTSLDDVKPPHQPDAANAAAGGGGATTGAAASAGADSPAASSTSGASQCSPSSAGYVLTTENISRMLDGWARKKGGGGGRRAAGSGPATPGATESASGSSEASEVSYGGTALSAAAAPASAFEYETKPTVTAAAAADAGDETQLSAIESWLFADADGIESGSLLDAAMDYTF

SEQ ID NO: 104 - DNA, 1230 bp, Oryza sativa
atggccgggggaggcggtagcctggcggtgggcggcggattgaacgggtggcgaggcgtcagcggcagcgtcggagctgcggggctagaggagggtagtgggccggcttggtggcgggggcatctaaccgccaacggctcgaggatgaagaagggggggggttctcgccggcacgctattccaactggcgaggcgggtagcggcgcggtcagtagagtcgccgtggccgtggccgtgtatgtggactcgtcgatcgagcaggagcagttggaggaggtggtgccgtggtggggattgatggggaggccgccgtgctgcgtgaaggcggaggtgaagaaggggccgtggacgccggaggaggacctcatgctcgtcgcctacgtccaggagcacggcccgggcaactggcgcgccgtgcccaccaacaccgggctgatgcggtgcagcaagagctgccggctccggtggaccaactacctccggccggggatcaagcgggggaacttcaccgaccaggaggagaagctcatcgtccacctccaggccctcctcggcaacaggtgggcggcgatcgcgtcctacttgccggagaggacggacaacgacatcaagaactactggaacacgcacctcaagaagaagctcaagaagatgagcgccaccggcggcggcggcgacgacggcgagggaggtggcgccggcgaggtgaagaccagggcggctgcgccgaaggggcagtgggagcggcgcctgcagacggacatccacaccgcgcgccaggcgctccgcgacgcgctctcgctggacccctcgccgccggccaagccgctggactcgtcgtcgggcgccacggcgccgccgtcgtcgcaggcggcgacgtcgtacgcatccagcgccgagaacatcgcgcggctcctggagggctggatgcgccccggcggcggcggcggcaagacgacgacgacgccgtcctccgggtcgaggtcgtcggcggcgtcggtgctgtccggggaggccagccacagcggcggcgccacggcgccgacgcccgacggctcgacggtcaccagcaagacgaaggacgaggagaccgccggcgcgccgccgccgccgccgccgccggcgttctccatgctggagagctggctgctcgacgacggcatgggccacggcgaggtggggctcatggacgtggtggtgccattgggggacccgagtgagttcttttag

SEQ ID NO: 105 - protein, 409 aa, Oryza sativa
MAGGGGSLAVGGGLNGWRGVSGSVGAAGLEEGSGPAWWRGHLTANGSRMKKGGGSRRHAIPTGEAGSGAVSRVAVAVAVYVDSSIEQEQLEEVVPWWGLMGRPPCCVKAEVKKGPWTPEEDLMLVAYVQEHGPGNWRAVPTNTGLMRCSKSCRLRWTNYLRPGIKRGNFTDQEEKLIVHLQALLGNRWAAIASYLPERTDNDIKNYWNTHLKKKLKKMSATGGGGDDGEGGGAGEVKTRAAAPKGQWERRLQTDIHTARQALRDALSLDPSPPAKPLDSSSGATAPPSSQAATSYASSAENIARLLEGWMRPGGGGGKTTTTPSSGSRSSAASVLSGEASHSGGATAPTPDGSTVTSKTKDEETAGAPPPPPPPAFSMLESWLLDDGMGHGEVGLMDVVVPLGDPSEFF

SEQ ID NO: 106 - DNA, 966 bp, Oryza sativa
atggggaggccgccgtgctgcgacaaggtcggggtgaagaaggggccatggacgccggaggaggacctgatgctggtctcctacatccaggagcacggcgccggcaactggcgcgccgtgccgacgaacaccgggctgatgcgttgcagcaagagctgccggctccggtggacgaactacctcaggccggggatcaagcgggggaacttcaccgagcaggaggagaagctcatcgtccacctccaggctctcctcggcaaccggtgggcagcgatagcgtcgtacttgccggagaggacggacaacgacatcaagaactactggaacacgcacctcaagaagaagctcaagaagatgcaggccgccggaggtggggaagacagcggcgccgcctcggagggtggcggcggccgcggcgacggcgacggcggcgggaaaagcgtgaaggccgccgcacctaaggggcagtgggagcggcggctgcagacggacatccacacggcgcggcaggcgctgcgcgacgcgctctcgctcgaccaccccgacccgtcgccggcgacggcggcggcggcggcgacgccagcggggtcgtcggcggcgtacgcgtcgagcgcggacaacatcgcgcggctgctgcagggctggatgcgcccgggcggcggcggcggcggcaacggcaagggccccgaggcgtcggggtcgacctccacgacggcgacgacgcagcagcagccgcagtgctccggcgagggcgcggcatccgcgtccgcgtcggcgagccagagcggcgccgccgccgcggcgactgcccagacgccggagtgctcgacggagacgagcaagatggccaccggcggcggcgccggcggccccgcgccggcgttctcgatgctggagagctggctgctcgacgacggcggcatggggctcatggacgtggtgccattgggggaccccagtttttag

SEQ ID NO: 107 - protein, 321 aa, Oryza sativa
MGRPPCCDKVGVKKGPWTPEEDLMLVSYIQEHGAGNWRAVPTNTGLMRCSKSCRLRWTNYLRPGIKRGNFTEQEEKLIVHLQALLGNRWAAIASYLPERTDNDIKNYWNTHLKKKLKKMQAAGGGEDSGAASEGGGGRGDGDGGGKSVKAAAPKGQWERRLQTDIHTARQALRDALSLDHPDPSPATAAAAATPAGSSAAYASSADNIARLLQGWMRPGGGGGGNGKGPEASGSTSTTATTQQQPQCSGEGAASASASASQSGAAAAATAQTPECSTETSKMATGGGAGGPAPAFSMLESWLLDDGGMGLMDVVPLGDPSF

SEQ ID NO: 108 - DNA, 927 bp, Oryza sativa
atgggacggccgccgtgctgcgacaaggaggggatcaagaaggggccatggacgcccgaggaggacatcatcctcgtctcctacatccaagaacacggccccggcaactggagatcggttcccatcaacacagggctgatgaggtgcagcaagagctgcaggctgcggtggacgaactacctgcggccggggataaagcgcggcaacttcacggcgcacgaggaggggatcatcgtccacctccagtcgctgctcggcaaccgctgggccgccatcgcctcctacctcccccagcgcaccgacaacgacatcaagaactactggaacacccacctcaagaagaagctcgccgccgccgccaactccacttcagcagcctccaaccgccaccccatcttcgccgacgccaccttcccctccgccgccggcagccacacggtgagcagcaactccgatgtcaaccagatggcagccattgctaggcgctcccccttcgccgactgcccatcctcctcctacgcctccagcatggacaacatctccaagctgctcgacggcttcatgaagaccaactcgccgtcgccgccgccgccgccgctgcagcactatgacggcggctattacgacgacgtcaagcccgccgtcgatgtcgtcggcaaccccttgctgtcgtccttcgactgcatgtccggcgccgacctggactgctgcttcgacgttcatcagcagcagccggcgtcgtcgttcatggagtacggcggctatggcggcggctacggcgacgagagcaagcagcagctgatgaaccaggcggcggcgccgctgtcttcgattgagaagtggctgttcgacgaggcggcggcggagcaggttgccgacctcatggacctctccgatggttgctgctccgtcccaatgatgttttaa

SEQ ID NO: 109 - protein, 308 aa, Oryza sativa
MGRPPCCDKEGIKKGPWTPEEDIILVSYIQEHGPGNWRSVPINTGLMRCSKSCRLRWTNYLRPGIKRGNFTAHEEGIIVHLQSLLGNRWAAIASYLPQRTDNDIKNYWNTHLKKKLAAAANSTSAASNRHPIFADATFPSAAGSHTVSSNSDVNQMAAIARRSPFADCPSSSYASSMDNISKLLDGFMKTNSPSPPPPPLQHYDGGYYDDVKPAVDVVGNPLLSSFDCMSGADLDCCFDVHQQQPASSFMEYGGYGGGYGDESKQQLMNQAAAPLSSIEKWLFDEAAAEQVADLMDLSDGCCSVPMMF

SEQ ID NO: 110 - DNA, 936 bp, Oryza sativa
atgggccggccgccgtgctgcgacaaggaggggatcaagaaggggccatggacgcccgaggaggacatcatcctcgtctcctacatccaagaacacggccccggcaactggagatcggttcccatcaacactgggctgatgaggtgcagcaagagctgcaggctgcggtggacgaactacctgcggccggggataaagcgcggcaacttcacggcgcacgaggaggggatcatcgtccacctccagtcgcttctcggcaaccgctgggccgccatcgcctcctacctcccccagcgcaccgacaacgacatcaagaactactggaacacccacctcaagaagaagctcgccgccgccgccaactccacttcatcctccaaccgccaccccatcttcgccgacgccaccttcccctccgccgccggcggtagctacacggtgagcagcaactccgatgtcacccagatggcagccattgctaggcgctcccccttcgccgactgcccatcctcctcatacgcctccagcatggacaacatctccaagctgctcgacggcttcatgaagaccaactccccgtcgccgccgccgccaccgctgcagcactatgacagcggctattacgacgacgtcaagcccgccgtcgatgtcggcggcaaccccttgctgtcgtccttcgactgcatgtccggcgccgacctggactgctgcttcgacgttcatcagcagcaccagcagcagcagccggcgtcgttcatggagtacggcggctatggcggcggctacggcgacgagagcaagcagcagctgatgaaccaggcagcgccgccgctgtcatcgatcgagaagtggctgttcgacgaggcggcggcggagcaggtcgccgacctcatggacctctccgacggttgctgctccgtcccaatgatgttttaa

SEQ ID NO: 111 - protein, 311 aa, Oryza sativa
MGRPPCCDKEGIKKGPWTPEEDIILVSYIQEHGPGNWRSVPINTGLMRCSKSCRLRWTNYLRPGIKRGNFTAHEEGIIVHLQSLLGNRWAAIASYLPQRTDNDIKNYWNTHLKKKLAAAANSTSSSNRHPIFADATFPSAAGGSYTVSSNSDVTQMAAIARRSPFADCPSSSYASSMDNISKLLDGFMKTNSPSPPPPPLQHYDSGYYDDVKPAVDVGGNPLLSSFDCMSGADLDCCFDVHQQHQQQQPASFMEYGGYGGGYGDESKQQLMNQAAPPLSSIEKWLFDEAAAEQVADLMDLSDGCCSVPMMF

SEQ ID NO: 112 - DNA, 969 bp, Populus trichocarpa
atgggcagaccaccttgctgtgataagataggagtgaaaaaaggaccatggactcctgaggaagatatcatcttggtatcatatattcaagaacatggtcctgggaattggagagctgtgccaactagtacaggactgcttagatgcagtaagagttgcagattgagatggactaattacctaaggccagggatcaaacgtggtaattttaccgatcacgaggagaagatgataatccacctccaagcccttctaggcaacagatgggctgccatagcttcatacctccctcagagaacagataatgacattaaaaacttttggaacacacatttgaagaagaagttgagaaagcttcaagcagggcaagaaggtcagtctagagatgggttatcatcaacaggttcacagcaaatttctagaggccaatgggagagaaggcttcaaactgatatcaacatggctaggcaagccctatgcgaggccttgtctcccggtaaaccaagcagcttgttaaccgggttgaaaccctcttgtgggtatgaaaaaccagctacagaaccaatctatgcatcaagcactgaaaatatatccagattgctcaaaggatggatgataagtgggcctaagcagtcgctaaaaaattcaactactcagaattccttcatcgatacggctggagctgattcactgtctagtgaagggactcctgataaagcagacaaaaatggcactggattatcacaggcatttgaatcactctttggttttgactctttcgactcttcaaattcagatttctctcaatccatgtcgcctgatactggccttttccaagacgaaagtaagccaaattccagtgctcaagtgccactgtcattgattgagaggtggctatttgatgaaggagccatgcaagggaaagattacataaacgaagtcacaatagatgaagataatctcttctag

SEQ ID NO: 113 - protein, 322 aa, Populus trichocarpa
MGRPPCCDKIGVKKGPWTPEEDIILVSYIQEHGPGNWRAVPTSTGLLRCSKSCRLRWTNYLRPGIKRGNFTDHEEKMIIHLQALLGNRWAAIASYLPQRTDNDIKNFWNTHLKKKLRKLQAGQEGQSRDGLSSTGSQQISRGQWERRLQTDINMARQALCEALSPGKPSSLLTGLKPSCGYEKPATEPIYASSTENISRLLKGWMISGPKQSLKNSTTQNSFIDTAGADSLSSEGTPDKADKNGTGLSQAFESLFGFDSFDSSNSDFSQSMSPDTGLFQDESKPNSSAQVPLSLIERWLFDEGAMQGKDYINEVTIDEDNLF

SEQ ID NO: 114 - DNA, 909 bp, Zea mays
atggggaggccgccgtgctgcgacaagatgggggtgaagaaaggcccgtggacccccgaggaggacctcatgctcgtctcctatgtccaggagcacggccccgggaactggcgcgccgtgccgaccaacaccgggctgatgcggtgcagcaagagctgcaggttgcggtggacaaactacctccggccgggaatcaagcgcggcaactttaccgagcaggaggagaagctcatcgtccacctccaggctctccttggcaacaggtgggcggccatagcatcctacttgccgaagaggacggacaacgatatcaagaactactggaacacgcatcttaagaagaagctgaagaacatgcagggcggcgaagggggcgcgggagggaagcgcccggccgttcccaaggggcagtgggagcggcggctgcagactgacatccacacggcgcggcaggctctgcgcgacgcgctctcactggagccttcggcgacgccgctggccaaggtggagcctctgccgacggctccggggtgcgcgacgtacgcgtctagcgccgacaacatcgcgcggctgctggaggggtggctgcgcccgggcagcggcaaggggccggaggcgtcgggttcgacgtcgacgacggccacgacgcgccagcggccgcagtgctccggtgagggcacggcgtctgcgtcggcgagccacagtggcggggcggccgcgaacacggcggcgcagacccccgagtgctcgacggagaccagtaagatggccggcagctcggtcggcgcgggctccgcgccggcgttctcgatgctggagagatggctgctggacgacggcatggggcacgctgaggtggggctcatgaccgacgtggtgccattaggggaccccagtgagttcttttaa

SEQ ID NO: 115 - protein, 302 aa, Zea mays
MGRPPCCDKMGVKKGPWTPEEDLMLVSYVQEHGPGNWRAVPTNTGLMRCSKSCRLRWTNYLRPGIKRGNFTEQEEKLIVHLQALLGNRWAAIASYLPKRTDNDIKNYWNTHLKKKLKNMQGGEGGAGGKRPAVPKGQWERRLQTDIHTARQALRDALSLEPSATPLAKVEPLPTAPGCATYASSADNIARLLEGWLRPGSGKGPEASGSTSTTATTRQRPQCSGEGTASASASHSGGAAANTAAQTPECSTETSKMAGSSVGAGSAPAFSMLERWLLDDGMGHAEVGLMTDVVPLGDPSEFF

SEQ ID NO: 116 - DNA, 54 bp, Artificial sequence
  primer 1
ggggaccactttgtacaagaaagctgggtccatgtgattaaagcaaactcttca

SEQ ID NO: 117 - DNA, 54 bp, Artificial sequence; identical to SEQ ID NO: 116
  primer 2

SEQ ID NO: 118 - DNA, 1179 bp, Oryza sativa
ttgcagttgtgaccaagtaagctgagcatgcccttaacttcacctagaaaaaagtatacttggcttaactgctagtaagacatttcagaactgagactggtgtacgcatttcatgcaagccattaccactttacctgacattttggacagagattagaaatagtttcgtactacctgcaagttgcaacttgaaaagtgaaatttgttccttgctaatatattggcgtgtaattcttttatgcgttagcgtaaaaagttgaaatttgggtcaagttactggtcagattaaccagtaactggttaaagttgaaagatggtcttttagtaatggagggagtactacactatcctcagctgatttaaatcttattccgtcggtggtgatttcgtcaatctcccaacttagtttttcaatatattcataggatagagtgtgcatatgtgtgtttatagggatgagtctacgcgccttatgaacacctacttttgtactgtatttgtcaatgaaaagaaaatcttaccaatgctgcgatgctgacaccaagaagaggcgatgaaaagtgcaacggatatcgtgccacgtcggttgccaagtcagcacagacccaatgggcctttcctacgtgtctcggccacagccagtcgtttaccgcacgttcacatgggcacgaactcgcgtcatcttcccacgcaaaacgacagatctgccctatctggtcccacccatcagtggcccacacctcccatgctgcattatttgcgactcccatcccgtcctccacgcccaaacaccgcacacgggtcgcgatagccacgacccaatcacacaacgccacgtcaccatatgttacgggcagccatgcgcagaagatcccgcgacgtcgctgtcccccgtgtcggttacgaaaaaatatcccaccacgtgtcgctttcacaggacaatatctcgaaggaaaaaaatcgtagcggaaaatccgaggcacgagctgcgattggctgggaggcgtccagcgtggtggggggcccacccccttatccttagcccgtggcgctcctcgctcctcgggtccgtgtataaataccctccggaactcactcttgctggtcaccaacacgaagtaaaaggacaccagaaacatagtacacttgagctcactccaaactcaaacactcacacca

SEQ ID NO: 119 - protein, 16 aa, Artificial sequence
  motif 1
  VARIANT (7)..(7): / replace = "Phe"
  VARIANT (14)..(14): / replace = "Glu"
  UNSURE (15)..(15): Unknown amino acid
  VARIANT (16)..(16): / replace = "Gly"
QGSLSLIEKWLFDDXS

SEQ ID NO: 120 - protein, 11 aa, Artificial sequence
  motif 2
  VARIANT (3)..(3): / replace = "Ser"
  VARIANT (4)..(4): / replace = "Lys"
  VARIANT (5)..(5): / replace = "Met"
  UNSURE (7)..(7): Unknown amino acid
  VARIANT (9)..(9): / replace = "Phe"
NIARLLXGWMK

SEQ ID NO: 121 - protein, 6 aa, Artificial sequence
  motif 3
  UNSURE (5)..(5): Unknown amino acid
  VARIANT (6)..(6): / replace = "Asp"
YASSXE

SEQ ID NO: 122 - DNA, 861 bp, Solanum lycopersicum
atgagtagtgaaaaagaagatggtttaggtttgagtttgagcttaggaatcatgagttgccctcagaataatcataaaactacaccttctttacctttgaatctcttgcctttcatgcatcatcatcaagtttcttcagggagaaaagatgaaggtggagaaagggtaagagggggaatagatatgaatgaaccagcgaggatgataatagagtgtgatgatgaagaagatgaagaagaagatcaggtgttaatggtttcctcacctaacagcactgtttctagtgtgagtggaaagaggagtcatgacagagaagagaacgaaggggaaagggccaccagctcactggaggacgacggcggagatgcggcggcaaggaagaaactccggttgtctaaggagcaagctgccgttcttgaagagacattcaaggagcataacacacttaatccgaagcaaaaattggctctgtcaaaacagctgaatctcaggccaagacaagtggaggtgtggtttcagaacagaagggcaaggactaagttggagcaaaccgaagttgattgtgagtatttgaagcgttgctgcgaaaatctaacggatgaaaaccgacgtttgcagaaagaagttagtgagcttagagcattgaaactttctccacagttttacatgaacatgagccctccaacaacccttacaatgtgccctcaatgcgagcgcgtagctgtatcatcttcttcgtcctcatcgtcagtagtcaacgccactcgcgctcagaaccaccaagcgccggtgcctatgaacaagccatgggctgcaatgttcgcttctaaaacactggatgtgcagaggtcacaaatgtaa

SEQ ID NO: 123 - protein, 286 aa, Solanum lycopersicum
MSSEKEDGLGLSLSLGIMSCPQNNHKTTPSLPLNLLPFMHHHQVSSGRKDEGGERVRGGIDMNEPARMIIECDDEEDEEEDQVLMVSSPNSTVSSVSGKRSHDREENEGERATSSLEDDGGDAAARKKLRLSKEQAAVLEETFKEHNTLNPKQKLALSKQLNLRPRQVEVWFQNRRARTKLEQTEVDCEYLKRCCENLTDENRRLQKEVSELRALKLSPQFYMNMSPPTTLTMCPQCERVAVSSSSSSSSVVNATRAQNHQAPVPMNKPWAAMFASKTLDVQRSQM

SEQ ID NO: 124 - protein, 6 aa, Artificial sequence
  motif 1
  VARIANT (1)..(1): / replace = "Ser"
  VARIANT (2)..(2): / replace = "Arg"
RKKLRL

SEQ ID NO: 125 - protein, 24 aa, Artificial sequence
  motif 2
  VARIANT (17)..(17): / replace = "Glu"
RQVEVWFQNRRARTKLKQTEVDCE

SEQ ID NO: 126 - protein, 10 aa, Artificial sequence
  motif 3
  UNSURE (3)..(3): Xaa can be any amino acid, preferably one of Ala, Leu, Ile, or Thr
  VARIANT (6)..(6): / replace = "Pro"
  VARIANT (7)..(7): / replace = "Gln"
  VARIANT (9)..(9): / replace = "Lys" / replace = "Arg"
  VARIANT (10)..(10): / replace = "His"
TLXMCLSCER

SEQ ID NO: 127 - protein, 5 aa, Artificial sequence
  motif 4
  VARIANT (5)..(5): / replace = "Ala"
SPNST

SEQ ID NO: 128 - protein, 3 aa, Artificial sequence
  motif 5
LGL

SEQ ID NO: 129 - protein, 3 aa, Artificial sequence
  motif 6
  VARIANT (1)..(1): / replace = "Asp"
  VARIANT (2)..(2): / replace = "Asp"
  VARIANT (3)..(3): / replace = "Asp"
EEE

SEQ ID NO: 130 - protein, 5 aa, Artificial sequence
  motif 7
  VARIANT (1)..(1): / replace = "Gln" / replace = "Asp"
  VARIANT (3)..(3): / replace = "Lys"
ENRRL

SEQ ID NO: 131 - DNA, 2194 bp, Oryza sativa; identical to SEQ ID NO: 61

SEQ ID NO: 132 - DNA, 58 bp, Artificial sequence
  primer: prm10162
ggggacaagtttgtacaaaaaagcaggcttaaacaatgagtagtgaaaaagaagatgg

SEQ ID NO: 133 - DNA, 50 bp, Artificial sequence
  primer: prm10163
ggggaccactttgtacaagaaagctgggtacggatccatatttatctttc

SEQ ID NO: 134 - DNA, 1007 bp, Populus trichocarpa
tcggctcactggtgttcgagaggagtgaagatgggtgataaaaatgatggactgggcttgagtttgagcttgggattcgatgctacacaacaaaatcatcaacagcagccttctttgaagctaaatctcatgcccgtaccttcacaaaacaatcatagaaaaacttccttgactgacctctttcaatcatcagatagagcatgtggtacgaggttttttcaacgaggaattgacatgaacagggtgccagctgcagtgacagattgtgatgacgaaactggggtttcttcaccaaacagtacgctatccagcttaagtggtaaaagaagcgaaagagaacagattggagaagaaacagaagcggagagggcctcttgctctcgtgacagtgatgatgaagatggtgctggtggtgatgcttctaggaagaagctgagactctcaaaggaacagtctttagtgcttgaagagactttcaaggaacataatactcttaatcccaaggagaagctggccttggcaaagcagttgaatctcaggcctaggcaagtggaggtgtggtttcagaaccgaagagcaaggactaagttgaagcaaactgaagtcgattgcgagtacctaaagaggtgctgtgaaaatctaacagaggagaacaggaggttacagaaggaggtgcaagagcttagagcactgaaactttcccctcagctctacatgcacatgaaccctcccaccaccctcaccatgtgcccttcatgcgagcgagttgctgtctcgtcagcctcatcatcttctgctgctgccgcgtcctctgctcttgctccaactgcctcaacccgccaaccacaacgacccgtgcccattaacccttgggcaacaatgcccgtccaccaacgaacttttgatgctcctgcttccaggtcatgattgttagcttgaagtaggggctatttggtaaagataaaatggatgaaaggatttaggataagatttccaggcatccacag

SEQ ID NO: 135 - DNA, 1040 bp, Populus trichocarpa
tttgttgtttgagagggagagagagagaagatgggtgataaaaatgatggcttgggcttgagtttgagcttgggatatgctacacaacggaatcatcatcagcagccttctttgaagctaaatctcatgcctttggcttcacaaaacaaacataagaaaacttcctggactgacctctttcaatcaccagatagaacatgtgatacgaggttgtttcaacgagggattgacatgaacagggtaccggctgctgtggcagattgtgatgacgaaactggggtttcttcaccgaacagtacactatccagcttgatcagtggtaaaagaagcgaaagagaacagattggtgaagaaacagaagcagagagagcctcttgctctcgcggaagtgatgatgaagatggtggtgatgcttctaggaagaagctgagactgtcaaaggaacagtcgtcagtgcttgaagagaatttcaaggaacataatactctcaatcccgtgagcagtagcctttggtacgtggtggttttgtggttgcagaaggaaaagctggctttggcaaaacagttgaatctcaggccaaggcaagtggaggtgtggtttcagaacagaagagcaaggactaagttgaagcaaactgaagtagattgcgagtacctaaagacgtgctgtgaaaatctaacagaggagaacaggaggttactgaaggaggtgcaagagctcagagcactgaaactctccccacagctctacatgcacatgaaccctcccaccaccctcaccatgtgtccttcatgcaagcgtgttgtctcatcggcatcatcatcttctgctgctgtcgtgtcctctgctcttgctccaattgcctcgaccccccaaccacaacgaccggtgcccattaacccttgggcagcaatgcctatccaccatcgaacttttgatgctcccgcttctagttcatgatagtttgtttgaagtagggctattattgtaagaagataaaatggatggaagtaattaggataaaatatccagagaaacgt

SEQ ID NO: 136 - DNA, 1019 bp, Populus trichocarpa
ttctggtttttttgttggcaaaggaagaagatgatggctgggaaggaagatttgggtttgagtttaagtcttagtgttcctcaaaatcaacattctctgcagttgaatctcatgccttcactggttccatcgactgcttcttcttctctctctgggttccatcctcaaaaaccctcatggaatgtgaccttcccttcttcagatccaaactctaattcataccgggccgagacaagatcgttgcttcgaggaatcgacgtgaacaggttaccatcaacggctgattgtgaagaggaagcgggggtttcatctccaaacagcacgatatcgagtattagtgggaagagaagtgaaagagaaggtattaatggagatgagcatgagatggagagagcttcttctcatggaatcagtgatgaagaagatggtgaaacctcaagaaagaagctcaggctgtctaaagatcaggccgctattcttgaagagagcttcaaagaacacaacactctcaacccgaagcaaaagatggctttggctaagcagttaggactcagacctagacaagtggaggtgtggtttcagaacaggagggcaagaaccaagctgaagcaaaccgaggttgactgtgagttcttgaagagatgctgcgagaacttgacagaagagaacaggaggttgcaaaaggaggttcaggagcttagagctctcaaactttcaccacagttctacatgcaaatgaccccaccaaccaccctcaccatgtgcccatcatgtgagcgtgttgcagccccccccaccgcatcatccaccgttgatgccaggccccatccccatatcggtcctacccgtcataggcccgtccccatgaacccatgggctccggctgctccagtcacacgtggaccaacaccgtttgatgccatccgtcctcgatcgtaattacaacacgaaaccacaggcatcccggtcacttgattcatcactatcttcgctgatttgggaagaaaggtagctggtaa

SEQ ID NO: 137 - DNA, 1311 bp, Solanum lycopersicum
gatcctacaaactgtatttgcactagccaaaggaaaaaagctgtaactcttctgctacaaaagggaacaccccatttctcttcgttctgtcccctcttcctcccttaccccacccccaccaccatttcaaaccccatagcaagaaaaccaccattttctttcttctcttctaaaaaaggggaagaaagaagaaaaaaatagtggaattttttggttttctcagaggaggaaaaaaacagagcaagaaagatgagtagtgaaaaagaagatggtttaggtttgagtttgagcttaggaatcatgagttgccctcagaataatcataaaactacaccttctttacctttgaatctcttgcctttcatgcatcatcatcaagtttcttcagggagaaaagatgaaggtggagaaagggtaagagggggaatagatatgaatgaaccagcgaggatgataatagagtgtgatgatgaagaagatgaagaagaagatcaggtgttaatggtttcctcacctaacagcactgtttctagtgtgagtggaaagaggagtcatgacagagaagagaacgaaggggaaagggccaccagctcactggaggacgacggcggagatgcggcggcaaggaagaaactccggttgtctaaggagcaagctgccgttcttgaagagacattcaaggagcataacacacttaatccgaagcaaaaattggctctgtcaaaacagctgaatctcaggccaagacaagtggaggtgtggtttcagaacagaagggcaaggactaagttgaagcaaaccgaagttgattgtgagtatttgaagcgttgctgcgaaaatctaacggatgaaaaccgacgtttgcagaaagaagttagtgagcttagagcattgaaactttctccacagttttacatgaacatgagccctccaacaacccttacaatgtgccctcaatgcgagcgcgtagctgtatcatcttcttcgtcctcatcgtcagtagtcaacgccactcgcgctcagaaccaccaagcgccggtgcctatgaacaagccatgggctgcaatgttcgcttctaaaacactggatgtgcagaggtcacaaatgtaacttcagtattgtgttgggtagaggaagtgtttatagagcaaggagatgatttacaagagatgtgttgggttgggttttgagaggaacagtttgttgaatttgttcattttatttgtgtaggaaaatggtttttacttgtatggtaagagacataattgtgtttactaaactatttttattattatattatatagtattagc

SEQ ID NO: 138 - DNA, 1000 bp, Solanum lycopersicum
  misc_feature (66)..(66): n is a, c, g, or t
tctctaaatcaacaactccccatcatttctcctcatctttcttacctgaaaaaaataaataaattncttttcacatcactgctcttttttttagctctatttttcttcaagaaatctaaaaaaaagcaaacaaaaatgatggttgaaaaagaagatttggggttaagccttagccttagttttccagataacaataataataacaagaagaagaatactcagctcaatctttcacctttcaatctcattcaaaaaacttcttggactgattccttattcccttcttcagatcggaacattgagacatgtagagtggagaccaggacttttttgaaggggatagatgtgaatcggctgccggcgacgggagacgccaacaaggaagccggcgtttcgtcgccgaacagtacgatttcgagtgtgagtggaaataagagaagtgaaagagaagcaaataattgtgatcaagaggaacatgaaatggaaagaggtggttctgatgaagaagatggagaaacttctagaaagaaattaaggctatcaaaagaccaatctgccattcttgaagaaagtttcaaagaacacaacacactcaatccaaaacaaaagctggctttggctaaaagactgggattgaggcctaggcaagttgaggtgtggtttcagaataggagggcaaggacaaagttgaagcaaacagaagttgactgtgagtttttgaaaagatgttgtgagaatttgacagaggaaaacaggagattacaaaaagaagttcaagagttgagggcattaaagctttcacctcaattctacatgcaaatgacccctcccaccaccctcaccatgtgcccttcatgtgagcgtgtcgcgggcccaccgccatcctcatctgggcccacatccacaccaatgggccaggcccaacccaggcccatgccatttaacctatgggccaatgcactacatccgagatcatgattttgcaagaagggcgatttgg

SEQ ID NO: 139 - DNA, 1170 bp, Zea mays
ccctttgggggcccctttttacaaaaaaaagggggtggggaaaattggggccccccggggggatttttaagggggccccccccttttttttttttttttttttttttttttttttttttttttttttttttttttttttttttttttttttttttttttttttttttttttttttttttttttttttaacaactgaaaccttatatatgcaaagtagtagtaagacaattttgcatcacttatgagtacaaagacataagacatcgttatctatttttcagcaaataaaacactgccaaacaacgaagatttttatcatatcggactaataaacactactaagctgtaatagcctgcgagtataataagaaccaaacaaagaaaaaaagaagatccagccctaattagcactagctacttagctagcggtagcgattagcaagcgcatccatctcatgccatatcgtggtcgtggatcacggcctccgggctgggccgtcgacgaacacggggagagggccccagcagggccctgcacggcccgcctggtcggcggacgcggacgcggaggcgaggcgctcgcaggaggggcacatggtgagcgtggtgggcggcggcatgcgcgcgtagtggtgcggcgccacgagcttgagcgcgcgcagctccgcaacctcccgctgcagccgccggttctcctccgtcagcgtctcgcagcagcgcttcaggaactcgcagtccacctccgtctgcttcagcttcgtcctggctctgcggttctggaaccacacctccacctgacgcggcttcaggttcagctgcttcgccagcgccgccttctgcttggggttgagtgtgttatgctccttgaagctctcctcgaggacggcggcctggtccttggacaggcggagcttcttgcgcgacccaccgccggagtcctcgtcgtcgctgccgcctccggctctcggggtgtggtcggccacctctccgccgctcctcgccggcgctgcgcgcttcccgctgaggctgctggagagcgtgctgtttggtgacgacgacgcgccgccaggctcctcgtcgtcctcgctgcagctacccctcctggtatccccggcaggggcccggttcacgtccaccccccgcaggaacggcatctcgtggccgtggcgc

SEQ ID NO: 140 - DNA, 1145 bp, Populus trichocarpa
gttggaagctcatctttagtgttccaaaatatggagctggccttgagtctaggtgatacatcaaagcctttcaagtttcttgacaaaaccccaaagttatcaagcaaagatcttgggttttgcatgggcttagggagtggttttcctgcaacaacaagatcacaagacaaactaggtagccatgaaagtaactatcaagacgatgaaagaagggtatcatcagatccgccacttcaacttgatcttttgcccttctctcctgttcctcgtggacatcaggctccttccaggattcgctttccatggctgacagataacttggtgtccgaacctggttcaaccgaagcaccagggagaaggtttgatgtgaaccggttgtccatggatgatgctgatgaaggagcggcgatttcgtcgccaaatagtgcagcgtcgtcctttcaaatggattttgggattagaagtgggagagaccgtaagagagatttagatgctattgatgctgagagagcaagttcaagagcaagtgatgatgacgagaacggtttgacaaggaagaaactaaggctctctaaagaacaatcagcttttcttgaagagagcttcaaagagcacaataccctcaatcctaagcaaaagctagctttagcaaagcagttgaatcttcgtcctcgccaagtggaagtgtggtttcagaatcgaagggcaaggacaaaattgaagcagacagaagtagattgtgagtatttaaagaggtgctgtgagacattgacagaagagaacaggaggttacaaaaggaactgcaagaattaagagctttgaaaacttcacaacctttctacatgcagcttcctgccaccactctcaccatgtgtccttcatgtgagcgcgtggccaccaccaccacttcctcttcgggcaccaccaccaccaccaccaccaccaacccatccaccaccaccaccactagcaccaccagctctaaaccattgtcactacctgcaaagcctcggttatttcctttgtcacatggccaggtccaacctcaccatgctgcttcatgactcactatgactaattttttgaaaaagaacacaaaatgaaagactgggatagagtttttccccccttccccgtgtgtaaa

SEQ ID NO: 141 - DNA, 1091 bp, Populus trichocarpa
accgttgcaaccccatctgtgttccaaaatatggagctagctttgagtttaggtgatacttccaagcctttcaagtttcttgacaaaactccaaagttgtcaagcaaagatctcgggttttgcatgggcttagggagtggttttactgcatcaacaagatcgcacgacaaactaggtagccatgaaaataatcatcaagaagatgagcgaagagtctcttcagatccgccacttcaacttgttcttttacctttctctcctgttcctcgcaggcatcagcctccttcaaagactcgctttccatggctgacagataacttggtgtctgaaccgggctcaactgaaggatcagggagagggtttgatgtgaaccgtttgtccatggatgacgctgatgaaggagcggcgctttcgtcgccaaatagcgcggcctcgtcctttcaaatggattttgggattagaagtgggagaggcaataagagagatttagaggctatagaggcttcaagagcaagtgatgatgaagagaacggtttgacaaggaagaaactaaggctctctaaagatcaatcagcttttcttgaagagagtttcaaagaacacagtacccttaatcctaagcaaaagctagctttagcaaagcagttgaatcttcgtcctcgccaagtggaagtgtggtttcaaaacagaagggcaaggacaaaattgaagcagacagaggtagattgtgagtatttaaagagatgctgcgagacactgacaaaagagaacaggaggttacaaaaggaactgcaagaattaagagctttgaaaacttcgcaacccttctacatgcagcttcctgccaccactctcaccatgtgcccttcttgtgagcgcgtggccaccaccacaaccaccaccaatccatccactagcaccaccacctcgaaaacattgtcactgcctgctaaacctaggttatttccttcgtcacatggccaagtccaagctcatcaagctgcttcatgactcaccatgactagtaaaaaaaaaaaacaaaatgaaagacaggaggaacagtgatctccctttcccatttgtaaatagct

SEQ ID NO: 142 - DNA, 1341 bp, Arabidopsis thaliana
ccacaaccccatatctctttgtctgaaaaaactcttttgcatatataaataaatataagccatatcttttgaaactgtacgctgcacaagtgtagaggcagtggcacaacatctttaagaaagagagagagaaagagtcatttattcatttcctcgcttaaaatcttgagcacccagacagaattcttctttcttctttctggggttgagaaaaatgagtgaaagagatgatggattgggctaagtttgagcttgagtttaggttttaatcaaaaggacccgtcttcgaggttaaatccaatgcctctggcttcttatgctcttcatcacacatgcagcatatgcagcagagcaattataaccatcctcaaaagattcagaacacttggattaacatgttcagtcatcagagagaaactcggacatgagatcgtttctccggggaatagacgtgaacagagctccatcgacggtggtggtgacgtggaggatgaaggcgccggagtttcgtctccgaacagcaccgtctcaagcgtgatgagcgggaagaagagcgagcggagctaatggctgcggcaggtgcagttggaggaggtagagtagaagataatgagattgagagagcttcttgctcgctcggggtggtagcgacgatgaagacggtagcgggaacggagatgacagttcgaggaagaaactccgattgtctaaagaacaagcttggttcttgaagaaacttttaaagaacatagtacactcaatccgaagcaaaagatggctttggctaagcaattgaatctaggacgagacaagttgaagtgtggttccaaaaccgaagggcaaggacgaagctgaagcaaacggaagtagactgtgaatacttaagagatgttgcgagaatctaacggatgagaatcggagattgcaaaaggaagtgagtgagcttagggctttaaagcttctccacacttatacatgcacatgaaacctcccactactctcacaatgtgtccttcttgcgagcgagtcgctgttacgtctcttcgtcatcggtggctcctcctgtgatgaattcatcgtctccgatgggtccgatgagtccgtgggctgccatgcctctcggcaacgacctgctgctggttctcattagagtttaattagtctaaagataataggtttggtgatttgtttttattatatgttgaacggacttggaagttcttttcaagagttggtcccatgctcttctttcctttgttttattcagtttctatttatagtgaattctggataatggaaaatctactaatattattgtccaattattagtttggggaaaga

SEQ ID NO: 143 - DNA, 1153 bp, Arabidopsis thaliana
tgcccccagctagtcacatactcatgattgcaaaatctctctctctctctgcctctctatatattaacctttcttcttccttactttctcatcttctatctctcaaaagaaaagcagacaactttatttgcaaaaacagagtttttttttcttatcttgaaaagttcaacagaagatgatgttcgagaaagacgatctgggtctaagcttaggcttgaattttccaaagaaacagatcaactcaaatcaaatccatctgtttctgttactccttcttcttcttcttttggattattcagaagatcttcatggaacgagagtttacttcttcagttccaaactcagattcgtcacaaaaagaaacaagaactttcatccgaggaatcgacgtgaacagaccccgtctacagcggaatacggcgacgaagacgctggagtatcttcacctaacagtacagtctcaagctctacagggaaaagagcgagagagaagaagacacagatccacaaggctcaagaggaatcagtgacgatgaagatggtgataactccaggaaaaacttagactttccaaagatcaatctgctattcttgaagagaccttcaaagatcacagtactctcaatccgaagcagaagcagcattggctaaacaattagggttacgagcaagacaagtggaagtttggtttcagaacagacgagcaagaacaaagctgaacaaacggaggtagactgcgagttcttacggagatgctgcgagaatctaacggaagagaaccgtcggctacaaaaagaagtacggaattgagagcacttaagctctctcctcagttctacatgcacatgagcccacccactactttgaccatgtgcccttctgtgaacacgtgtcggtcccgccaccacaacctcaggctgctacgtcagcgcaccaccggtcgttgccggtcaatgcgtggctcctgcgacgaggatatctcacggcttgacttttgacgctcttcgtcctaggtcctaagtctttttacttgcaaccaagggcattttggtcgttttttaagtttcatggaccagatatgcatgtagttgttaacatgtatgtattttcttagaaagaagaaaaacagattaatatttttctagcttaaacc

SEQ ID NO: 144 - DNA, 1269 bp, Arabidopsis thaliana
aataatgatggattgtaattagccacctgacaaaatctctcatcattcaaagtactatattaatcccctctcttcttcataccatctcacatctctctctatttctcttccacaaagagtcctaacttcgagttgaaacaaacaccatttctcatctctactcagaaagaacaaaccatttcgtgttctttctttctctattctcataaggaaatataattcctgaaactgttgagttctgtgaaaggaaataaaaaacatgatgatgggcaaagaagatctaggtttgagcctaagcttagggttttcacaaaatcacatcctcttcagatgaatctgaatcctaactcttcattatcaaacaatctccagagactcccatggaaccaaacattcgatctacatcagatcttcgcaagatagacgtgaacagttttccatcaacggttaactgcgaggaagacacaggagtttcgtcacaaacagtacgatctcaagcaccattagcgggaagagaagtgagagagaaggaatctccggaaccggcgttggctccggcgcgatcacgacgagatcactccggatcgagggtactcacgtggaacctcagatgaagaagaagacgggggcgaaacgtcgagaagaagctcaggttatcaaaagatcagtctgcttttctcgaagagactttcaaagaacacaacactctcaatcccaaacgaagctagctttggctaagaagctgaacttgacggcaagacaagtggaagtgtggttccaaaacagaagagctagaaccagttaaagcaaacggaggtagattgcgaatacttgaaacggtgcgtagagaagctaacggaagagaaccggagacttcagaagaggctatggagcttcgaactctcaagctgtctccacaattctacggtcagatgactccaccaactacactcatcatgttccttcgtgcgagcgtgtgggtggcccatcatcatcgaaccatcaccacaatcacaggcccgtttctatcaatccgtgggtgcttgtgctggtcaggtggctcatgggctgaattttgaagccttgcgtccacgatcgtgattttttattttagtggtggaaaagggtgttttggtatttttcgttatcgttatatagtctatctgtgtggggtcattgtaattttggatgattggcctttcatgaactagtcctatgtatgatgcaaccttaaaaagatttaaattagcaaaaattagttacaaactt

SEQ ID NO: 145 - DNA, 946 bp, Arabidopsis thaliana
atgggggaaagagatgatgggttgggtttgagtctaagcttgggaaatagtcaacaaaaagaaccatctctgaggttgaacttatgccgttgacaacttcttcttcttcttcttcgtttcaacacatgcacaatcagaataacaatagccatccccagaaattcataacatctcttggactcatctgtttcaatcttctgggattaaacgtacaactgcagagagaaactccgacgccggtcatttctaagaggtttcaacgtgaacagagctcagtcttcggtggcggtagtggacttggaagaagaagccgccgtcgttcgtctccaaacagcgccgtttcgagtctgagtggaaataaaagggatcttgcggtggcgagaggaggagatgaaaacgagcggagagagcttcttgctcacgcggagggggaagcggtggtagcgacgatgaagacggcggaaacggcgacggatcaagaagaaactacggttatcgaaggatcaagctcttgttctcgaggagacttttaaagaacatagcactcttaatccgaagcaaagctggctctagcaaaacagttgaatctaagggcaagacaagttgaagtgtggtttcagaaccgtagggcaaggacgaactgaaacaaacggaggttgattgtgagtatttaaagagatgttgcgataatctgaccgaggagaatcgacggctgcagaagaagtgtcggagctgagggcgttgaagttgtctccacatctctacatgcacatgactcctcctactactctcaccatgtgccttcttgcgaacgtgtctcctcctctgccgccactgtgaccgctgctccttccactactactactcctacggtggtgggcggccaagtccacagcgattaactccttggactgctatttctctccagcaaaaatcaggtcgctag

SEQ ID NO: 146 - DNA, 1334 bp, Oryza sativa
acgctttaaaagcttcctcctcctcctcgccaaccaccaccctcagtccctcacctccatttccatcaagcccaagaacgactcaccacgctagtgttgagaagtggagagagttgagaggaatcaatggagatgatggttcatgggaggagagacgagcgtatggcgggctcaggctcgggcttgggcttgggctcagcctcggcgtcgccggtggtgcagccgacgacgagcagccgcgccgcgccgtggtgccgccccgccgccgcagcagcagctgtgcggctggaacggcggcggtctcttctcctcgtcttcctcgatcatcgggggaggtcggcgatgatggcgtgccacgacgtcatcgagatgccgttcctgcgggggatcgacgtgaacctgcgccggcggcagagacgaccacgacgacggcgagggggcccagctgcagcgaggaagacgaggagcccggcgcgtcctccccaacagcacgctctccagcctcagcggcaagcgcggcgcaccatctgccgccaccgccgccgccgccgccgccagcgcgacgaggactccggcggcggatcccgcaagaagctccgcctctccaaggaccaagccgccgtcctcgaggacaccttcaagagcacaacaccctcaatcccaagcagaaggcggcgctggcgaggcagctgaatctgaagccgcggcaggtggaggtgtgttccagaacaggagggcgaggacgaagctgaagcagacggaggtggactgcgagctgctcaagcgctgctgcgagacgccaccgacgagaaccgccgcctccaccgcgagctccaggagctccgcgccctcaagctcgccaccgccgccgccgcgccgcccacctctacggcgcccgcgtcccgccgcccaccaccctcaccatgtgcccctcctgcgagcgcgtcgcctccgcagccacaccacccgcaacaactccggcgccgcccccgcgcggccggtgcccacccgcccgtggccgccggcggcggcgcagaggtgtcggcgtagagaccccactactgattaattagttaattagagatgagtagtggctttttcttaattagcagggtattaataattacttaattagggttggacccctgtagttttcttgtttatactacgtgtataatttagctctggttttgaacttttaattagtttcataatctttttttttcctatctctcacttcaccctgtttgttgtttactcagcaaagaatatggtgtcttgtataaagtgatgcatgaaatggatcataaaagttttcaatattaattccttca

SEQ ID NO: 147 - DNA, 566 bp, Populus trichocarpa
tttcaacgaggaattgacatgaacagggtgccagctgcagtgacagattgtgatgacgaaactggggtttcttcaccaaaagtacgctatccagcttaagtggtaaaagaagcgaaagagaacagattggagaagaaacagaagcggagagggcctcttgtctcgtgacagtgatgatgaagatggtgctggtggtgatgcttctaggaagaagctgagactctcaaaggaacagtctttgtgcttgaagagactttcaaggaacataatactcttaatcccaaggagaagctggccttggcaaagcagttgaatctcagcctaggcaagtggaggtgtggtttcagaaccgaagagcaaggactaagttgaagcaaactgaagtcgattgcgagtacctaagaggtgctgtgaaaatctaacagaggagaacaggaggttacagaaggaggtgcaagagcttagagcactgaaactttccctcagctctacatgcacatgaaccctcccaccaccctcaccatgtgcccttcatgcgagcgagttgctgtctcgtcagctcatca

SEQ ID NO: 148 - DNA, 1334 bp, Oryza sativa; identical to SEQ ID NO: 146

SEQ ID NO: 149 - DNA, 1517 bp, Oryza sativa
gagctggggccccaccccaccccgcgtcgcaattaataattggtcgcgactcgcgacgagatccactcgcaccagctcatatttgctcctccactccaccactatttataaccccccttcgcctcctccacccccactcatctcctccacctcctccacccgccgccatttgatcgaacacctgatagccatgatggatctcggcctcagcctcggcctcggcctcgcctcgcagggcagctcacctcctccaccaccaccacctcctcccccggcgccggatcatcctccccgtgggccgccgcgctcaactccatcgtggcgacgtgaggcgggatcaggccgcggcgcatgctgccgcggcggtgggggttggggttgggggcgaggagatgtaccagggagggcgtccacgtcgccggacagcgcggcggcgctgtcgagcgcgagcgggaagagggagagggagctggagcggtcggatccggggttgacgacgacgacggcgcggacggcgccggcgggcggaagaagctcaggctgtccaaggaccaggccgcgtgctcgaggagtgcttcaagacgcactccactctcaaccccaagcagaaggtggcgctggcgaacaggctggggctgcgccgcggcaggtggaggtgtggttccagaaccggagggcgaggacgaagctgaagcagacggaggtggactgcgagtacctaagcggtggtgcgagcgcctcgccgacgagaacaagcgcctcgagaaggagctcgccgacctcagggcgctcaaggccgcccctcgccggcgtccgcgtccgcgatgcagccctcctcctccgccgccgccacgctcaccatgtgcccctcctgccgccggtcgccaccgccggcgcgccgcaccagcctaaccaccaacaatgccatcccaaatctaacaccaccatctcctcctcctcaccgccgccgccgccgtcgccgtcgccggcggcaacgtgctgcccagccactgccagttcttcccggccgccgccgccgcgccgaccggacaagccagagcacgtggaacgccgccgcgccgctcgtcaccagagagctcttctagaaacaatccatccacgccatgacaaacttgggaaaggatcaagctttgattggtcaagacagtgtttttaccaggtggtgatttggttaattaataattataattaatcactcaagaggaggggattaattgccttgatttggtacctaattactagtatgattagcagtagtatagtagcagcaaatttggtttggattaattcagtttgattccatgatatgaacaaaggaacaaagcaacaaaaaaatggcgtctgctttttcttggacggcattcttatatgtaccaattcaccaaatctgctggttggtggattaacagcttgataattgtatattgattgtactactaccactaattgattgaattatgagaaaagttaatgaaatcttttctaattcttcagca

SEQ ID NO: 150 - DNA, 1251 bp, Oryza sativa
ttaggtcaaagcagcagcctcgatcgcaaactgcaggatcgtcgctggctgggcctcaagaatctccaaagcagatccaccacgcgccaccagctcatcattgtcgaccaatcttcttttcttgatttcaatccatgatcttctcatctatttatacccccgtcttcttctcctcctctcttcatcgtctccgacgccgacgaactcccactcactagtagcacttacttgtagctattgtctagagcacttaagacatggagaggcaaggcttggatcttggcctgagcctcgggctaggcttgacgacggcggcgacaggccggctgctgggttctgtctgaactccggcatggcggagcaggaagtgatcaggcgtgatgatgtggttgcggcgacgcggcggaggatgagaggttcgcgtgctcacccggcagcccggtgtcgagcggcagcgggaagcgaggcagcggcagcggcgcggcgacgaggtcgacgacgccggctgcgacgtcggcggcggcggcgcgcgcaagaagctgcggttgtccaaggaccagccgccgtcctcgaggagtgcttcaagacgcaccacaccctcactccgaagcagaaggtggcgctggcgaagagcttgaactgcggccgcggcaggtggaggtgtggttccagaaccgccgcgcgaggacgaagctgaagcagacggaggtggactgcgagacctcaagcggtggtgcgaccagctcgccgacgacaaccgccgcctccacaaggagctcgccgagctcagggcgctcaagccacgcccacaccgcccgccgccgcgccgccattgaccaccctcacaatgtgcctctcctgcaagcgcgtcgccaatgccgcgtgccctcgccggcggcggcgatattccccggccacccccagttcttgtgcggattcagagatcacgccggagcagcgcgtcgtcgtacggcggcgcatcatctggactcgcgaaggcggtcagggcggcgaggtagatcgatcgatgcgcgcgccgcatgatcgacatgaccaagctagcgatctctagctagaagatgatgacattgagcaagacgcaagagtagaacagagttgattgatctctcgttttcctgtgtatttttaaggatcaagtgcaaagttaatttagtttttgacaaatgtaggatggatccagtatgcacatgaaaagttgatgaaataacatgagaagaactaattaattga

SEQ ID NO: 151 - DNA, 1661 bp, Oryza sativa
acttccaagttccaactctcagctagctgcaaactctactcagtttgcatcgagatatacagagatcgagtagtcagagcgagagctagtggagagaaagcaccagggaagaacgcagagagaggttacagggagcgatgatggagagggccgaggacctcgcctgagcctcagtctcagctcgccgcttattgctcctcgtactcaccatgtcgccatgctgttccacgctcctccagaaaaagattcctggagatgccgctgctccctgctgcgaagcggagcgaggtcgtcgcggcagaagaggagcgcgcgggcctcgcggcggcggcggcagcgacgaggaggacggtggctgcggcatcgacggctcacgcaagaagctccggctttccaaggacagtccgccgtgctcgaggacagcttccgggagcaccccaccctcaaccccaggcagaaggcaactttggcgcagcagctgggcttcggcctcggcaggtcgaggtgtggtttcagaacagacgcgcaaggacgaagctgaagcagacggaggtggactggagttcctgaagcgctgctgcgagacgctcacggaggagaaccggaggctgcagaaggaggtgcaggagctgcgagcgctaagctcgtctcgccgcacctctacatgaacatgtccccgcccaccacgctcaccatgtgcccctcctgcgagcgcgtctcaacaccaataacaactccagcgccgccgccgccgccgaccgccgcggcatcaggactactactgccgcaggcggcggcaggtcgtcgacaccgccgccgacgggggcatcctctgccaccgcccgatcgccgtccggccgcagcagtcatgacaagctagtagctttttacttcctagctagacagactacacccgtacactgtccccatgtgtcaacgaggcagcaagcagtgtacgtgacattatattcgcgcaagctgtgtgtgttgcgctcaccgatcgatcgctcagttgttgtttttttcctttttgttggaagagctagctggctagctattagcatggtgttcatgcgtcaggtggagtagtagctataggcggcgctgggatagaacaggatgtctcggcagcttctggccggcggtggtggtgttcgcgggcgggccggctgggagctgggcgtagcgaatatttagctgtccaggggaaagttggatatggtgggatacgggtgtaggggaagtggggcgcagcgggatggcacggtggtttgttctgtccggctgacgatgacggcgatgatgatgagagggtcagtttgtttgttggacagtcgtttctcttaagcttgattctagcattaatttaacacgggtaggcatgtgcatttggtctctgctgagcttaatttaggtgattagtagtgtgttctttaattgccggccgggaaagccatagcttgcatgcatgcatgaaagtttccttgtgttttgatgggatattatccgctaactgaaaggttcgatcggtttgttcgcttaatcatgtgaacggctaaatataaatatgtactactactggatatcgagtaacgaatcactggatataatcgaattgaattgcccggtcgaggaatatgcaccattcgatcggaggtggt

SEQ ID NO: 152 - DNA, 1342 bp, Glycine max
ttcattctctttctcttttcctttcacacaaactcctcttatgatgggtcttgatcaagatgctagcagcaactctggccttcagcttattctagggttagctttgactgccaccaccaccaccactccatcatcaccaccatccatttccaacaagcttgatcatgttgatcatcaccaccatcttataactcttagaccaacaacaaagtcatcctataattcctctgaggctgaaccatcattaacgttgggtctttcccgggagagttacctcaaagtccccaaaagcatcataggacacaacaacaacaaagtctcatcctgtgatgaccctcttgacttgtccacacagactaattcacctcatcacagtgctgtttcctccttctccagtggcagggtcaagagggagagggatctcagctgtgaagaagttgtggatgcaaaagagattgatcagagggatcttagctgtgaaggaataataagagccaccgaagaagaagaagacggcgccgccaccagaaagaaacttaggctcaccaaagaacaatctgctttgctagaagaaagcttcaaacaacatagcaccctcaatcctaaacagaagcaagctttgtcgaagcagttaaatctaaggccacgacaagttgaggtgtggttccagaacaggagagccagaacaaagctgaagcagacagaggtggactgcgagttcctaaagaaatgttgtgaaacattaacagatgaaaacagacggttacagaaggagcttcaagagctgaaggcactgaaactggctcagccgttgtacatgcctatgcctgcggcaacactcgccatgtgcccctcttgcgagaggctcggcggcagcgccgtcaacggtgccggcggttcccccaagacatcattctccatggcccctaagcctcacttcttcaaccccttcgccaatccttctgcagcatgttgattgatattgttattataattaggcttttagttttcattaaaaaaaacaaaagacaaccaaagaagagttcccccacaacctttgtatttttttggttgagggatacgtcttatgaaccagtgaaaaaaggctaaaggtgtaattaactaatatactgtagaaatttgtaaccgctgattagaattactttttactcttcctttattaatgtttttttatggatccctatagaagacatccatctatgaaggaattaatgactattttttttaatagaccacggtcgcaatggtatattcatttgtcaaacaaaagaggccttgagaatacgcgcaagcgctcgctcatcacaaaaaaaaaaaaaaa

SEQ ID NO: 153 - DNA, 1222 bp, Triticum aestivum
gctcagaccagatcattacatcaccaccaccgagcactgccaccgtacgaaccatcgtccatcctcccagtccggggggcgcactctcagatcggatcgggtacgccggagacaagagacgatgatgcatcgcgccgacggcctcgacctgggcctcgggctggggctcggcctcgcttcccagggcagcatcacgtcctccaccaccaccgccgcatcctcctccccggcctccgcctcccactcgcagcactggaccgccgcgctcagctccgtcatcggcctgcggaaggaggaaccgggggtgcaggcttccacgtcgcccgagagcggcggcacaaagaggggcctggaacggaccggctccggcctggccgcgggcagcgacgaggacgacgacggcggtgatggcaccggcgggcgcaagaagctcaggctctccaaggaccaggccgccgtcctcgaggaatgcttcaagacgcacagcacgcttaaccccaagcagaagacggcgctggcgaaccggctgggcctccggccgcggcaggtggaggtgtggttccagaaccgccgggcgcgcaccaagctcaagcagacggaggtggactgcgagtacatgaagcgctgctgcgagcagctcgccgagcagaaccgccgcctcgagaaggaggtagccgagctccgcgcgctcaaggccgcgccgccggcgcacagcgcggcagcagcggcggggccactgaccaccctcaccatgtgcctctcctgcaagcgcgtcgcgtccacgtcttctgcctcggcctgcgacgtgcccaacttttccactaatgccggcatgggcatgcccatgccatccccggtggcactgccagaccaccggcagtttttttgcgggtacagagacaccggagcaacgtacggcggcttttcgggcctcgccaaggtggtcaagccggccagatagaacgagctatttctgtgacgccgccatgatcagcatgccaagcaagctataacaaaaatggcggcattgtcacaactcacaaacttaagctggtttagcagaaagtttagtccttcgttttctcagtctcagggggaaatgtaagttaattaattctagcaatttagggccgaattatccatcgaaatgagttcccggcggggatggatgtatgaatgtgaaaattaatgaaatgacatgagaaataattccccactcaaa

SEQ ID NO: 154 - DNA, 738 bp, Medicago truncatula
cggccgggcggcggcgacgacggaagacgtcgacgacggcacctcattgtcatcccccagcagttctgtgtcaccatttgcaatggatttcagtatgaggaataataacaatgctgaatatggaggaagaaataagagagaaaatgaaggtgaagctgaaagaggaagtgatgatgatgaaaatgggtcaactaggaagaaactaagactctctaaagatcaatctgcttttcttgaagaaagtttcaaagaacacaccactcttaatcctaagcaaaaacttgcacttgcaaaacagttgaatcttagtcctcgtcaagttgaagtttggtttcaaaatagaagagcaaggacaaagttaaagcaaacagaagtggattgtgagtatttgaagagatgttgtgagacattaacagaagagaatagaagattacaaaaggaacttcaagagcttagagctttgaaaactactcaaccattctacatgcaacttccagctaccactctcactatgtgtccttcttgtgaacgtgtagctacaaacccttgcaacaaccaaacaaacaccaacaagtcaagattctctaatgctcaagcccaagcccaagcccatcagatttcttcatgaccttataatcttatatgatcacatggaaaattttcttttttatttggttttcagataatatatatgatagataatatcatagagggtgtgacaaagtgttaattagtttc

SEQ ID NO: 155 - DNA, 1328 bp, Arabidopsis thaliana
tccataaggccacaacagatcttcttgttcctctctctcaatctctctctctaaaactcttattttcttcgtaagagatggaactagcgttgtctctaggcgacaatactaagaaacagttctcttttatggagaagaactcgaagattaataatccctctgtctcgtcgacatctacttccgagaaggatcttgggttctgcatggctttagatgttgcttttggtggtcacagatcgttgtcatcctcttcgtctccgtcggtagaggatgagaagaagaaaccggcgcccagagcaaaaaaatctgacgaatttagggtttcgtcttctgtagatccaccattacagcttcagcttcacttccctaattggctccctgagaacagtaaaggtcgacaaggaggaagaatgcccttaggagcagctacggttgtggaggaggaagaggaggaggaggaagcggtgcctagtatgtcagtatcgccgccggatagtgtaacgtcgtcgtttcaattggactttgggattaaaagttatggttatgagagaagaagcaataagagagatattgatgatgaagtggagagatcagcttcaagagccagcaacgaagacaacgatgacgagaatggatccactaggaagaaacttagactctccaaagaccaatctgcttttcttgaagacagcttcaaagaacacagtacccttaatcctaaacagaagattgcattggcgaagcagttgaatcttcgtcctcgtcaggttgaagtctggtttcaaaacagacgagccaggacaaagctgaagcaaacggaagtggactgtgaatacctaaagagatgctgtgagtcactaaccgaagaaaaccggaggcttcaaaaagaggttaaagaattgagaaccttgaagacttccacacccttttacatgcaacttccggccactactctcactatgtgcccttcttgtgaacgtgttgccacttcagcagcacagccctccacgtcagctgcccacaacctctgtttgtccacgtcatcattgattccggttaagcctcggccggccaaacaagtttcatgaaagcacctgcgaaatacagtttgagcaaacggtcgagctagagtggttttaaaagttgtcttcttgtgtatatatttattttacttttcatattttattagagaccgctattttgaaagacgaatagattgattatccggttagtgttttgtttttcttagataggaccggataaaaaacagatggagcaaaagggttgacatgttttattgaatgatagaggaatatagaagaagacaa

SEQ ID NO: 156 - DNA, 1017 bp, Craterostigma plantagineum
  misc_feature (879)..(879): n is a, c, g, or t
  misc_feature (883)..(883): n is a, c, g, or t
  misc_feature (907)..(907): n is a, c, g, or t
  misc_feature (943)..(943): n is a, c, g, or t
  misc_feature (972)..(972): n is a, c, g, or t
  misc_feature (980)..(980): n is a, c, g, or t
  misc_feature (984)..(984): n is a, c, g, or t
ttaggtttgagcctgggaagttttggcccgagcagcagtggaggctcgcatccgccgccggcgttgcctcttccttcgaatcttttccggccatctttgcaggagattgatagaacgcagaggtctatcggtgcatttcttcaggcaccaactgctgctgccgtttgcagagagcccgcgtcagctttccgtgggatcgacgtgaatcgacctccgaccatcgtagactgcggagaagagaataataatccgatcgcctcgccgtcgccgaacagcaccgtctgtagctcaagcgggaaaaggaccagcggcgagagagaggagaaggaagacggagatagggctgcgtcgagctccttcgaggttgaagacgacgacggcggcggcggcgacgcctcggcgaggaagaagctccgcctatccaaggagcaggccgtggtcctcgaggagaccttcaaggagcacagcaccttgaatcccaaggaaaagatcgccctggcgaagcagttgaatctcatgcccaggcaagtggaggtttggtttcagaacagaagggcaaggacgaagctgaagcagacagaagtggattgcgagtatctgaggagatgctgcgagaatctaacagaagaaaaccgaagattgcagaaagaagtcaatgagcttcgagcccttaaactgtcgcctcagttctacatgagcccacccacgaccctaaccatgtgccctcagtgcgagcgcgtggctgcacagccgtcttcagccgccgctatccgcccgccgagccaccaccagaggccggcggcgggtatgaactcttgggctgctatgatttcgcctcgcccatcatgacataagctttagttttttttttcatctgtntganaattggggcaaatttgtaaatttntcgtatttgatgggttgcttttgggttaggaaaaanagcctattgtaggaaaaattgcctctaanatcagtcnccanattgtattttatgaaattatttcattttattgc

SEQ ID NO: 157 - DNA, 909 bp, Pimpinella brachycarpa
atgatgattcatcaaagagaagatcacttgggtctaagcctaagcttgtcctctccagctcacaggccttcatcatcttcatcaccactccaactaaatctagcaccttccatgccaaccccatcaaccccacctttcaacctcttccacaaaaaagaaacctcagatgggtacattcttgacgcgtgcagagtcgaaacgaggtcgtttctgaagggaatcgatgttaaccggctaccggcgacgacagtggacatggaagaagaagctggggtgtcatcacccaacagcacaatatcaagtgtgagtggaaagaggagtcttgagagatctgagaatggtaatggagatgatcttctagattgttctagagggctgattaatagtgatgaagaagatggtgataattctagaaagaaactcaggctttctaaagaccagtccgctattcttgaagatagttttaaagaacacaacactcttaatccaaagcaaaagctggccttggcaaaaagactagggttgagacctcgtcaggtggaggtttggttccagaatagaagggcaaggaccaagttgaagcaaaccgaggttgattgtgagttcttgaaaagatgctgtgagaatctaacagatgaaaataggagattgatgaaggaggttcaagaactgagggcactcaaattatccccacaattctatatgcaaatgacccctcccacaaccctcaccatgtgcccttcatgtgagcgtgtctcggctccaccatcgtcttctacaggcccatcttccacacccgtcgagaccccccggccccaccattcgggttctagtcaccatcgcgtcgcttttaatccatgggccattgcacctgctggtcaccgatcattcgatgcagttccccattga

SEQ ID NO: 158 - DNA, 1211 bp, Arabidopsis thaliana
ttctcttttcatttcccatttcacatctctctctctctataagaaccctagaagaaggtttctcttgtcctccatacacttagcacaactgataaatcttttgaggtaaaatcagctttagatcaaggtttttctagtcatctctactcataaagatcaaagcttttgctattctcattttctaccaagagacaatatcatgatgatgggtaaagaggatttgggtttaagtcttagcttgggatttgcacaaaaccatcctctccagctaaatcttaaacccacttcttcaccaatgtccaatctccagatgtttccatggaaccaaacccttgtttcttcctcagatcaacaaaagcaacagtttcttaggaaaatcgacgtgaacagcttgccaacaacggtggatttggaagaggagacaggagtttcgtctccaaacagtacgatctcgagcacagtgagtggaaagaggaggagtactgaaagagaaggtacctccggtggtggttgcggagatgaccttgacatcactctagatagatcttcctcacgtggaacctccgatgaagaggaagattacggaggtgagacttgtaggaagaagcttagactatccaaagatcaatccgcagttctcgaagacactttcaaagagcacaatactctcaatcccaaacagaagctggctttggctaagaagctaggtttaacagcaagacaagtggaagtgtggttccaaaacagaagagcaaggacaaagttaaagcagaccgaagtggattgcgagtatttgaaaagatgtgttgagaaattaacggaagagaatcggcggctcgagaaagaggcagcggaactaagagcattaaagctttcaccgcggttgtatggtcagatgagtccaccgaccacacttttgatgtgtccatcgtgtgaacgtgtggccggaccatcctcatctaaccacaaccagcgatctgtctcattgagtccatggctccaaatggcccatgggtcaacctttgatgtgatgcgtcctaggtcttaactttaatgctgcttctatgggttgtgtgtgggtcattgtactttttagattattgactctcagctaatgtatccttaaaagcctttttctacttttaaatttactttaatctaattaaattagttattcttgtcttcttgataacaaacaaatttataataat

SEQ ID NO: 159 - DNA, 651 bp, Silene latifolia
atgcggggagtcgcgtcaccgaacagtactgtctcgactgtaagcggaaagcggagtttgtgtgaaagagattctacatctgcaggcgccgctgatgatttggatttggaaagagcttcgtctcgtggtttgagtgatgatgaagatggtggtgataattctaggaagaaacttcgtttgactaaagatcaatctgctattcttgaagatagttttaaagaacataacactcttaatcccaagcaaaaactggctctggctaaacgacttggactaggaccacgtcaggtggaggtatggttccaaaaccggagggcaaggacaaagttgaagcaaacggaggtagactgtgaatttctaaagcgttgttgtgaacaattaacggaggaaaacagaaggttacaaaaggaggttcaagagttacggacattaaagttgtccccacagttttacatgcaaatgaccccaccaactacattaactatgtgtccttcttgtgaacgtgtggctgccccaccctctggtccagtccagcccaagcctcatccctcactcgaatctcggtccagtattcgtcctgtggcgaataacccctgggttactgcagcggttcccatccggtcttttgatgctattcacccccgttcttga

SEQ ID NO: 160 - DNA, 1125 bp, Populus trichocarpa
atggagcttggattaagcttgggagatgcagctactgcttcaaagccatttgggttcatggagaaatctacaaagctcaccaacaaagccagtttagggttttgcatgggcttatcaattggtcaaaatcacacaccacaagaagatgaagataaagagaaacacggcaataatgatcataaatctgacaatacaaacacaacaacaacagcagaagccaataagagaaaaggtctgacagtagacaccaccgattcacctatccagctcgatcttctccctaacactcctgtccctcgtaaccgaaacagctcccccacttatgtggtctatgataatggtaacatgtcaagaggttttgatgtgaatagattccctgctgtgatggttcatgaagatcaggctgatcaagatgtggctgccctttcatcttcaccaccgaacagtgcaacctcttcttttcaaatggatttttgcatgtacagtagtaaaggtagaagtgaatcacataatgaagctgatcaagctgaaagagcttcttcaagagccagtgatgaagatgaaaatggtagcgctagaaagaaactcaggctctctaaagatcagtctgcttttcttgaagaaagcttcaaagagcacaatactctcactcctaaacaaaagcttgcacttgctaaagagcttaatctccgtcctcgccaagtagaagtctggtttcaaaatagaagagcaaggaccaaattgaagcaaactgaagtggattgtgagtacttgaagagatgttgtgagacattaacagaagagaatagaagattacataaggagcttcaagaattaagagctttaaagacttcaaatccattttacatgcaacttccagccactactctcaccatgtgcccctcttgtgagcgagttgccaccacttccacctccaccgcagccgccaccaccaccaccgccactcccacagcaaccgctgcaaccaccaccaccacaaccaataaccagaacaacaccgctgaccccacatctaaaaccacagggttgtcgcttggtagtactagaccaaggttctatccattttctcacacacagactcaccaccaccagcacacagcatga

SEQ ID NO: 161 - DNA, 1077 bp, Picea sitchensis
atggacctgggtttgggcttaggtggtgaagatatcgttgtgaggcctgctgagtcttggatacagtttcagaatatgacgagcgcaacaaaggccgatctcgttcaaaacacggaactgtttctacggctgggactggaactgggttcgcagaggcaaaatacagccaatcccaaccctcccattcagctggatctgcttcctgcagcgcctgttccgcgcggtttttcatggcaccccaacactaaaacttaccgagcggcctctgaaaacggaaactgcgaaggagattacggagaaaccagatcctgtggtcaaggtggaggagctgcgtcggcgtcttccccccggggtttcgatgtgaaccgagttccctcctccgcagacaacgacaatgaggacgacgacgatgcagcggtctcgtcgcccaacagcaccatatcgtcgtttcagatggatttcgccatttgtcatgcgaccagtgctgtgaagagggagagggacggggagcgtgataacaacgctaatgacaacgaactggatagagattgctccagaggaagcgacgaagaagaagggggcggcaccaggaaaaagctccgcctttccaaagagcagtctgcttatttggaagaaagcttcaaagagcacaatacccttaatccgaagcaaaaactggcattggctaagcagcttaaccttcgcccgcgtcaagtagaagtctggttccagaaccgaagagcaaggacgaagctaaagcagacagaagtggactgcgaatatcttaagagatgctatgaaacccttacagaagagaacaggcgattgcagaaagatattcaagaactgagggctctgaaagtggcgcatccaagcttttacatgcacttgcctgcaaccactctcaccatgtgcccttcctgcgagaggatcgcctcagcctcagcaccaccagatagcaacgccaagggcctccatggccatggccacgggtacgggcacggacctaccccatggccgaccctcgcttctgctcatttacgcccgattcggccgcctcctagacttgaacaataa

SEQ ID NO: 162 - DNA, 855 bp, Glycine max
atgacggttcaaaaggaagatttgggcttgagtctaagtttgagcttccctctcctctcctcttctccttccagccacaaccctcagaaaccctcttggaacgaccctattttcacttcttcaggtgaagctggatcattcctccgcggaatcgatgtgaaccgtttaccttctgtggttgattgcgaagaggaagcaggtgtttcatctccaaacagcacggtttctagcgtcagtggaaagcgcagcgagagggaaaccaatggagaagaaaacgacacagacagagcttgttccagaggcatcatcagcgacgaagaagatgctgaaacctctagaaagaaacttagactctccaaagatcagtcaattgtcctggaagagagcttcaaagaacacaacactcttaaccccaagcaaaagttggcactggcgaaacagctgggtcttcgagcgagacaagtggaggtgtggttccagaacagaagggcaaggacgaagctgaagcaaacggaggttgactgcgagtttttgaaaaggtgctgcgagaatctgacggaggaaaacaggaggttgcagaaggaagtgcaagagcttagagcactgaaactttccccgcagttctacatgcacatgaccccacccaccaccctcaccatgtgcccctcgtgtgagcgtgtcgcggttcccccctcctctgccgttgatcctgccacgcgtcaccatcacgtgcctccatctcacccccgggcctttcccattggccatggccaggcccttcgatgccctccgtcccagatcttagactcgcggaaacaaaatgacaaaattgaaaaaaaagataggaagccatga

SEQ ID NO: 163 - protein, 298 aa, Populus trichocarpa
MGDKNDGLGLSLSLGFDATQQNHQQQPSLKLNLMPVPSQNNHRKTSLTDLFQSSDRACGTRFFQRGIDMNRVPAAVTDCDDETGVSSPNSTLSSLSGKRSEREQIGEETEAERASCSRDSDDEDGAGGDASRKKLRLSKEQSLVLEETFKEHNTLNPKEKLALAKQLNLRPRQVEVWFQNRRARTKLKQTEVDCEYLKRCCENLTEENRRLQKEVQELRALKLSPQLYMHMNPPTTLTMCPSCERVAVSSASSSSAAAASSALAPTASTRQPQRPVPINPWATMPVHQRTFDAPASRS

SEQ ID NO: 164 - protein, 309 aa, Populus trichocarpa
MGDKNDGLGLSLSLGYATQRNHHQQPSLKLNLMPLASQNKHKKTSWTDLFQSPDRTCDTRLFQRGIDMNRVPAAVADCDDETGVSSPNSTLSSLISGKRSEREQIGEETEAERASCSRGSDDEDGGDASRKKLRLSKEQSSVLEENFKEHNTLNPVSSSLWYVVVLWLQKEKLALAKQLNLRPRQVEVWFQNRRARTKLKQTEVDCEYLKTCCENLTEENRRLLKEVQELRALKLSPQLYMHMNPPTTLTMCPSCKRVVSSASSSSAAVVSSALAPIASTPQPQRPVPINPWAAMPIHHRTFDAPASSS

SEQ ID NO: 165 - protein, 302 aa, Populus trichocarpa
MMAGKEDLGLSLSLSVPQNQHSLQLNLMPSLVPSTASSSLSGFHPQKPSWNVTFPSSDPNSNSYRAETRSLLRGIDVNRLPSTADCEEEAGVSSPNSTISSISGKRSEREGINGDEHEMERASSHGISDEEDGETSRKKLRLSKDQAAILEESFKEHNTLNPKQKMALAKQLGLRPRQVEVWFQNRRARTKLKQTEVDCEFLKRCCENLTEENRRLQKEVQELRALKLSPQFYMQMTPPTTLTMCPSCERVAAPPTASSTVDARPHPHIGPTRHRPVPMNPWAPAAPVTRGPTPFDAIRPRS

SEQ ID NO: 166 - protein, 286 aa, Solanum lycopersicum
MSSEKEDGLGLSLSLGIMSCPQNNHKTTPSLPLNLLPFMHHHQVSSGRKDEGGERVRGGIDMNEPARMIIECDDEEDEEEDQVLMVSSPNSTVSSVSGKRSHDREENEGERATSSLEDDGGDAAARKKLRLSKEQAAVLEETFKEHNTLNPKQKLALSKQLNLRPRQVEVWFQNRRARTKLKQTEVDCEYLKRCCENLTDENRRLQKEVSELRALKLSPQFYMNMSPPTTLTMCPQCERVAVSSSSSSSSVVNATRAQNHQAPVPMNKPWAAMFASKTLDVQRSQM

SEQ ID NO: 167 - protein, 280 aa, Solanum lycopersicum
MMVEKEDLGLSLSLSFPDNNNNNKKKNTQLNLSPFNLIQKTSWTDSLFPSSDRNIETCRVETRTFLKGIDVNRLPATGDANKEAGVSSPNSTISSVSGNKRSEREANNCDQEEHEMERGGSDEEDGETSRKKLRLSKDQSAILEESFKEHNTLNPKQKLALAKRLGLRPRQVEVWFQNRRARTKLKQTEVDCEFLKRCCENLTEENRRLQKEVQELRALKLSPQFYMQMTPPTTLTMCPSCERVAGPPPSSSGPTSTPMGQAQPRPMPFNLWANALHPRS

SEQ ID NO: 168 - protein, 225 aa, Zea mays
MPFLRGVDVNRAPAGDTRRGSCSEDDEEPGGASSSPNSTLSSSLSGKRAAPARSGGEVADHTPRAGGGSDDEDSGGGSRKKLRLSKDQAAVLEESFKEHNTLNPKQKAALAKQLNLKPRQVEVWFQNRRARTKLKQTEVDCEFLKRCCETLTEENRRLQREVAELRALKLVAPHHYARMPPPTTLTMCPSCERLASASASADQAGRAGPCWGPLPVFVDGPARRP

SEQ ID NO: 169 - protein, 344 aa, Populus trichocarpa
MELALSLGDTSKPFKFLDKTPKLSSKDLGFCMGLGSGFPATTRSQDKLGSHESNYQDDERRVSSDPPLQLDLLPFSPVPRGHQAPSRIRFPWLTDNLVSEPGSTEAPGRRFDVNRLSMDDADEGAAISSPNSAASSFQMDFGIRSGRDRKRDLDAIDAERASSRASDDDENGLTRKKLRLSKEQSAFLEESFKEHNTLNPKQKLALAKQLNLRPRQVEVWFQNRRARTKLKQTEVDCEYLKRCCETLTEENRRLQKELQELRALKTSQPFYMQLPATTLTMCPSCERVATTTTSSSGTTTTTTTTNPSTTTTTSTTSSKPLSLPAKPRLFPLSHGQVQPHHAAS

SEQ ID NO: 170 - protein, 326 aa, Populus trichocarpa
MELALSLGDTSKPFKFLDKTPKLSSKDLGFCMGLGSGFTASTRSHDKLGSHENNHQEDERRVSSDPPLQLVLLPFSPVPRRHQPPSKTRFPWLTDNLVSEPGSTEGSGRGFDVNRLSMDDADEGAALSSPNSAASSFQMDFGIRSGRGNKRDLEAIEASRASDDEENGLTRKKLRLSKDQSAFLEESFKEHSTLNPKQKLALAKQLNLRPRQVEVWFQNRRARTKLKQTEVDCEYLKRCCETLTKENRRLQKELQELRALKTSQPFYMQLPATTLTMCPSCERVATTTTTTNPSTSTTTSKTLSLPAKPRLFPSSHGQVQAHQAAS

SEQ ID NO: 171 - protein, 312 aa, Arabidopsis thaliana
MSERDDGLGLSLSLSLGFNQKDPSSRLNPMPLASYASSSHMQHMQQSNYNHPQKIQNTWINMFQSSERNSDMRSFLRGIDNRAPSTVVVDVEDEGAGVSSPNSTVSSVMSGKKSERELMAAAGAVGGGRVEDNEIERASCSLGGGSDDEDGSGNGDDSSRKLRLSKEQALVLEETFKEHSTLNPKQKMALAKQLNLRTRQVEVWFQNRRARTKLKQTEVDCEYLKRCCENLTDENRRLQKVSELRALKLSPHLYMHMKPPTTLTMCPSCERVAVTSSSSSVAPPVMNSSSPMGPMSPWAAMPLRQRPAAGSH

SEQ ID NO: 172 - protein, 281 aa, Arabidopsis thaliana
MMFEKDDLGLSLGLNFPKKQINLKSNPSVSVTPSSSSFGLFRRSSWNESFTSSVPNSDSSQKETRTFIRGIDVNRPPSTAYGDEDAGVSSPNSTVSSSTGKRSEREEDTDPQGSRGISDDEDGDNSRKKLRLSKDQSAILEETFKDHSTLNPKQKQALAKLGLRARQVEVWFQNRRARTKLKQTEVDCEFLRRCCENLTEENRRLQKEVTELRALKLSPQFYMHMSPPTTLTMCPSCEHVVPPPQPQAATSAHHRSLPVNAWAPATRISHGLTFDALRPRS

SEQ ID NO: 173 - protein, 280 aa, Arabidopsis thaliana
MMMGKEDLGLSLSLGFSQNHNPLQMNLNPNSSLSNNLQRLPWNQTFDPTSDLRKIDVNSFPSTVNCEEDTGVSSPNSTISTISGKRSEREGISGTGVGSGDDHDEITPDRGYSRGTSDEEEDGGETSRKKLRLSKDQSAFLEETFKEHNTLNPKQKLALAKLNLTARQVEVWFQNRRARTKLKQTEVDCEYLKRCVEKLTEENRRLQKEAMELRTLKLSPQFYGQMTPPTTLIMCPSCERGGPSSSNHHHNHRPVSINPWVACAGQVAHGLNFEALRPRS

SEQ ID NO: 174 - protein, 318 aa, Arabidopsis thaliana
MGERDDGLGLSLSLGNSQQKEPSLRLNLMPLTTSSSSSSFQHMHNQNNNSHPQKIHNISWTHLFQSSGIKRTTAERNSDAGSFLRGFNVNRAQSSVAVVDLEEEAAVVSSPNSAVSSLSGNKRDLAVARGGDENEAERASCSRGGGSGGSDDEDGGNGDGSRKKLRLSKDQALVLEETFKEHSTLNPKQKLALAKQLNLRARQVEVWFQNRRARTKLKQTEVDCEYLKRCCDNLTEENRRLQKEVSELRALKLSPHLYMHMTPPTTLTMCPSCERVSSSAATVTAAPSTTTTPTVVGRPSPQRLTPWTAISLQQKSGR

SEQ ID NO: 175 - protein, 308 aa, Oryza sativa
MEMMVHGRRDEQYGGLRLGLGLGLSLGVAGGAADDEQPPPRRGAAPPPQQQLCGWNGGGLFSSSSSDHRGRSAMMACHDVEMPFLRGIDVNRAPAAETTTTTARGPSCSEEDEEPGASSPNSTLSSLSGKRGAPSAATAAAAAASDDEDSGGGSRKKLRLKDQAAVLEDTFKEHNTLNPKQKAALARQLNLKPRQVEVWFQNRRARTKLKQTEVDCELLKRCCETLTDENRRLHRELQELALKLATAAAAPHHLYGARVPPPTTLTMCPSCERVASAATTTRNNSGAAPARPVPTRPWPPAAAQRSSA

SEQ ID NO: 176 - protein, 189 aa, Populus trichocarpa
FQRGIDMNRVPAAVTDCDDETGVSSPNSTLSSLSGKRSEREQIGEETEAERASCSRDSDDEDGAGGDASRKKLRLSKEQSVLEETFKEHNTLNPKEKLALAKQLNLRPRQVEVWFQNRRARTKLKQTEVDCEYLKRCCENLTEENRRLQKEVQELRALKLPQLYMHMNPPTTLTMCPSCERVAVSSASS

SEQ ID NO: 177 - protein, 311 aa, Oryza sativa
MEMMVHGRRDEQYGGLGLGLGLGLSLGVAGGAADDEQPPPRRGAAPPPQQQLCGWNGGGLFSSSSSDHRGRSAMMACHDVIEMPFLRGIDVNRAPAAETTTTTARGPSCSEEDEEPGASSPNSTLSSLSGKRGAPSAATAAAAAASDDEDSGGGSRKKLRLSKDQAAVLEDTFKEHNTLNPKQKAALARQLNLKPRQVEVWFQNRRARTKLKQTEVDCELLKRCCETLTDENRRLHRELQELRALKLATAAAAPHHLYGARVPPPTTLTMCPSCERVASAATTTRNNSGAAPARPVPTRPWPPAAAQRSSA

SEQ ID NO: 178 - protein, 308 aa, Oryza sativa
MMDLGLSLGLGLASQGSLTSSTTTTSSPGAGSSSPWAAALNSIVGDVRRDQAAAHAAAAVGVGVGGEEMYQGRASTSPDSAAALSSASGKRERELERSGSGVDDDDGADGAGGRKKLRLSKDQAAVLEECFKTHSTLNPKQKVALANRLGLRPRQVEVWFQNRRARTKLKQTEVDCEYLKRWCERLADENKRLEKELADLRALKAAPSPASASAMQPSSSAAATLTMCPSCRRVATAGAPHQPNHQQCHPKSNTTISSSSTAAAAVAVAGGNVLPSHCQFFPAAAAAADRTSQSTWNAAAPLVTRELF

SEQ ID NO: 179 - protein, 256 aa, Oryza sativa
MERQGLDLGLSLGLGLTTAATWPAAGFCLNSGMAEQEVIRRDDVVAATAAEDERFACSPGSPVSSGSGKRGSGSGSGDEVDDAGCDVGGGGARKKLRLSKDQAAVLEECFKTHHTLTPKQKVALAKSLNLRPRQVEVWFQNRRARTKLKQTEVDCEHLKRWCDQLADDNRRLHKELAELRALKATPTPPAAAPPLTTLTMCLSCKRVANAGVPSPAAAIFPGHPQFLCGFRDHAGAASSSYGGASSGLAKAVRAAR

SEQ ID NO: 180 - protein, 247 aa, Oryza sativa
MMERAEDLRLSLSLSSPLIAPRTHHVAMLFHAPPEKRFLEMPLLPAAKRSEVVAAEEERAGLRGGGGSDEEDGGCGIDGSRKKLRLSKDQSAVLEDSFREHPTLNPRQKATLAQQLGLRPRQVEVWFQNRRARTKLKQTEVDCEFLKRCCETLTEENRRLQKEVQELRALKLVSPHLYMNMSPPTTLTMCPSCERVSNTNNNSSAAAAADRRGIRTTTAAGGGSVVDTAADGGILCHRPIAVRPQQS

SEQ ID NO: 181 - protein, 311 aa, Glycine max
MMGLDQDASSNSGLQLILGLALTATTTTTPSSPPSISNKLDHVDHHHHLITLRPTTKSSYNSSEAEPSLTLGLSRESYLKVPKSIIGHNNNKVSSCDDPLDLSTQTNSPHHSAVSSFSSGRVKRERDLSCEEVVDAKEIDQRDLSCEGIIRATEEEEDGAATRKKLRLTKEQSALLEESFKQHSTLNPKQKQALSKQLNLRPRQVEVWFQNRRARTKLKQTEVDCEFLKKCCETLTDENRRLQKELQELKALKLAQPLYMPMPAATLAMCPSCERLGGSAVNGAGGSPKTSFSMAPKPHFFNPFANPSAAC

SEQ ID NO: 182 - protein, 279 aa, Triticum aestivum
MMHRADGLDLGLGLGLGLASQGSITSSTTTAASSSPASASHSQHWTAALSSVIGLRKEEPGVQASTSPESGGTKRGLERTGSGLAAGSDEDDDGGDGTGGRKKLRLSKDQAAVLEECFKTHSTLNPKQKTALANRLGLRPRQVEVWFQNRRARTKLKQTEVDCEYMKRCCEQLAEQNRRLEKEVAELRALKAAPPAHSAAAAAGPLTTLTMCLSCKRVASTSSASACDVPNFSTNAGMGMPMPSPVALPDHRQFFCGYRDTGATYGGFSGLAKVVKPAR

SEQ ID NO: 183 - protein, 208 aa, Medicago truncatula
GRAAATTEDVDDGTSLSSPSSSVSPFAMDFSMRNNNNAEYGGRNKRENEGEAERGSDDDENGSTRKKLRLSKDQSAFLEESFKEHTTLNPKQKLALAKQLNLSPRQVEVWFQNRRARTKLKQTEVDCEYLKRCCETLTEENRRLQKELQELRALKTTQPFYMQLPATTLTMCPSCERVATNPCNNQTNTNKSRFSNAQAQAQAHQISS

SEQ ID NO: 184 - protein, 336 aa, Arabidopsis thaliana
MELALSLGDNTKKQFSFMEKNSKINNPSVSSTSTSEKDLGFCMALDVAFGGHRSLSSSSSPSVEDEKKKPAPRAKKSDEFRVSSSVDPPLQLQLHFPNWLPENSKGRQGGRMPLGAATVVEEEEEEEEAVPSMSVSPPDSVTSSFQLDFGIKSYGYERRSNKRDIDDEVERSASRASNEDNDDENGSTRKKLRLSKDQSAFLEDSFKEHSTLNPKQKIALAKQLNLRPRQVEVWFQNRRARTKLKQTEVDCEYLKRCCESLTEENRRLQKEVKELRTLKTSTPFYMQLPATTLTMCPSCERVATSAAQPSTSAAHNLCLSTSSLIPVKPRPAKQVS

SEQ ID NO: 185 - protein, 282 aa, Craterostigma plantagineum
LGLSLGSFGPSSSGGSHPPPALPLPSNLFRPSLQEIDRTQRSIGAFLQAPTAAAVCREPASAFRGIDVNRPPTIVDCGEENNNPIASPSPNSTVCSSSGKRTSGEREEKEDGDRAASSSFEVEDDDGGGGDASARKKLRLSKEQAVVLEETFKEHSTLNPKEKIALAKQLNLMPRQVEVWFQNRRARTKLKQTEVDCEYLRRCCENLTEENRRLQKEVNELRALKLSPQFYMSPPTTLTMCPQCERVAAQPSSAAAIRPPSHHQRPAAGMNSWAAMISPRPS

SEQ ID NO: 186 - protein, 302 aa, Pimpinella brachycarpa
MMIHQREDHLGLSLSLSSPAHRPSSSSSPLQLNLAPSMPTPSTPPFNLFHKKETSDGYILDACRVETRSFLKGIDVNRLPATTVDMEEEAGVSSPNSTISSVSGKRSLERSENGNGDDLLDCSRGLINSDEEDGDNSRKKLRLSKDQSAILEDSFKEHNTLNPKQKLALAKRLGLRPRQVEVWFQNRRARTKLKQTEVDCEFLKRCCENLTDENRRLMKEVQELRALKLSPQFYMQMTPPTTLTMCPSCERVSAPPSSSTGPSSTPVETPRPHHSGSSHHRVAFNPWAIAPAGHRSFDAVPH

SEQ ID NO: 187 - protein, 282 aa, Arabidopsis thaliana
MMMGKEDLGLSLSLGFAQNHPLQLNLKPTSSPMSNLQMFPWNQTLVSSSDQQKQQFLRKIDVNSLPTTVDLEEEIGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 188 - protein, 216 aa, Silene latifolia
MRGVASPNSTVSTVSGKRSLCERDSTSAGAADDLDLERASSRGLSDDEDGGDNSRKKLRLTKDQSAILEDSFKEHNTLNPKQKLALAKRLGLGPRQVEVWFQNRRARTKLKQTEVDCEFLKRCCEQLTEENRRLQKEVQELRTLKLSPQFYMQMTPPTTLTMCPSCERVAAPPSGPVQPKPHPSLESRSSIRPVANNPWVTAAVPIRSFDAIHPRS

SEQ ID NO: 189 - protein, 374 aa, Populus trichocarpa
MELGLSLGDAATASKPFGFMEKSTKLTNKASLGFCMGLSIGQNHTPQEDEDKEKHGNNDHKSDNTNTTTTAEANKRKGLTVDTTDSPIQLDLLPNTPVPRNRNSSPTYVVYDNGNMSRGFDVNRFPAVMVHEDQADQDVAALSSSPPNSATSSFQMDFCMYSSKGRSESHNEADQAERASSRASDEDENGSARKKLRLSKDQSAFLEESFKEHNTLTPKQKLALAKELNLRPRQVEVWFQNRRARTKLKQTEVDCEYLKRCCETLTEENRRLHKELQELRALKTSNPFYMQLPATTLTMCPSCERVATTSTSTAAATTTTATPTATAATTTTTTNNQNNTADPTSKTTGLSLGSTRPRFYPFSHTQTHHHQHTA

SEQ ID NO: 190 - protein, 358 aa, Picea sitchensis
MDLGLGLGGEDIVVRPAESWIQFQNMTSATKADLVQNTELFLRLGLELGSQRQNTANPNPPIQLDLLPAAPVPRGFSWHPNTKTYRAASENGNCEGDYGETRSCGQGGGAASASSPRGFDVNRVPSSADNDNEDDDDAAVSSPNSTISSFQMDFAICHATSAVKRERDGERDNNANDNELDRDCSRGSDEEEGGGTRKKLRLSKEQSAYLEESFKEHNTLNPKQKLALAKQLNLRPRQVEVWFQNRRARTKLKQTEVDCEYLKRCYETLTEENRRLQKDIQELRALKVAHPSFYMHLPATTLTMCPSCERIASASAPPDSNAKGLHGHGHGYGHGPTPWPTLASAHLRPIRPPPRLEQ

SEQ ID NO: 191 - protein, 284 aa, Glycine max
MTVQKEDLGLSLSLSFPLLSSSPSSHNPQKPSWNDPIFTSSGEAGSFLRGIDVNRLPSVVDCEEEAGVSSPNSTVSSVSGKRSERETNGEENDTDRACSRGIISDEEDAETSRKKLRLSKDQSIVLEESFKEHNTLNPKQKLALAKQLGLRARQVEVWFQNRRARTKLKQTEVDCEFLKRCCENLTEENRRLQKEVQELRALKLSPQFYMHMTPPTTLTMCPSCERVAVPPSSAVDPATRHHHVPPSHPRAFPIGHGQALRCPPSQILDSRKQNDKIEKKDRKP

SEQ ID NO: 192 - DNA, 1839 bp, Medicago sativa
atgtcgtccgccgctgggggcggcgggtacggcggcggccagggtggaggcgcggagcaccaccaccaccaccacgggcacgccggtcacctcctgctccaccaccatccgcagcacgtggccggcgcggccgttgcggcagcggccgcggcggcgggcgggcagatgtaccacgtgccccagcacagccggcgcgagaagctccggttcccgccggacgccggggactcgccaccgcctcatggtcatggtcatggtcatgccccgcagcagcagcagcagcacgggtcgtggcctccgcccccggcgttctactcgtacgcgtcctcgtcgtcgtcgtactccccgcacagccctactctagcgcaggcgcagctggtggcgcacgggctggcgccgccgctcccgcagatcccgacgcagaacttctcgctgtcgctctcctccgcgtcgtcgaatcctccaccaccgcaggcgcagccgaggaggcagctcggcggcctcgcgcaggccacggggccgttcggtcccttcaccggctacgccgccgtgctcggccggtcccgtttcctcggcccggcagagaagctgttcgaggagatctgcgacgtcggcggcgctgcttcgcacgtcgaccgcaccatctccgacgagggcctgctcgacgcggatccgatggacggcgtcgatcatgacgtcgttgatcacgacctcggcggcgctgaccgcgcagcggccgacgctggccccatctcgggggccgagcagcagtggaagaagacgaagctcatctccatgatggaagaggtttgcaagaggtaccggcagtactaccagcaggttcaggctgtgatggcctcgttcgagaccgtcgccgggttcagcaacgccgcgccgttcgcggcattggcgctgagggcgatggcgaagcacttcaagtgcttgaagagcatgattctgaaccagctgcgcaacacgagcaacaaggtcgctgtgaaggacgggctaaacaaggagatcgccgtgttcgggctcgccgggggtagcagcggcggcgccggcctccagcgagcgaacagcgcgagcgcgttcggccagccgcacaatatttggcgcccacagagggggctccccgagcgcgctgtgtccgttttacgcgcgtggctgttcgaacacttcctgcacccgtatcctaccgatggtgataagcaaatgctagcaaaacaaacaggcttgacacgcaaccaggtatcgaactggtttatcaacgcaagggttaggttgtggaagccaatggtggaagaaattcacaacctagagatgaggcaaatgcacaagcactcggtggttgacaagggccagcatagcgtgcatcatcaggcccagcattcttcgcagtgcagcgggaatccctccgttccttcggactcccatcctggacagagcagcagcataactcggaaccacaacaccgctgcctcccagggcttcccggatgagctctcccagatgtcccagtccatccagggacaggtgagcttcgcatacaacgggctgacctcgcagcacaacattgcatcaccacatcatcagcaccagcaggtcggcggtgttggtatcggaggcggcaatggcggtgtctccctcacccttggtcttcaccagaacaacagggtctgcatcgccgagcctctcccggctgctctcccggccaacctagctcaccgtttcggactggaggaagtcagtgacgcctatgtgatgagctcatttggaggtcaggaccggcatttcgggaaggagattggtggtcacttgctgcatgattttgtcgggtga

SEQ ID NO: 193 - protein, 612 aa, Medicago sativa
MSSAAGGGGYGGGQGGGAEHHHHHHGHAGHLLLHHHPQHVAGAAVAAAAAAAGGQMYHVPQHSRREKLRFPPDAGDSPPPHGHGHGHAPQQQQQHGSWPPPPAFYSYASSSSSYSPHSPTLAQAQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDADPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLAGGSSGGAGLQRANSASAFGQPHNIWRPQRGLPERAVSVLRAWLFEHFLHPYPTDGDKQMLAKQTGLTRNQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVGIGGGNGGVSLTLGLHQNNRVCIAEPLPAALPANLAHRFGLEEVSDAYVMSSFGGQDRHFGKEIGGHLLHDFVG

SEQ ID NO: 194 - DNA, 1551 bp, Arabidopsis thaliana
atggctgaggagggttttgaaaattattatcatatcccacaacaaagtagaagagaaaaacttcgttatttatctcaaaaccaaacaagtttcattgaatcttcacccacccttaaccctagtttttcacctttaccttctctttacgatccttcactcatttcacctttagatgctataaacagtaacccttttctttatcaaatgaatcatgtatacaaccatggtggtagtaatagtaacaacaatgaagttatgttgttaaaatctgaaccattatctttgtctttatcgtcaaacaaaaacaaccagaatcagatgagtgctgctaattttcagcgttatggttctgttgttgatgtttctaggaacacggttccgttaggaccgtttacgggttatgcttctgttttgaagggatcgaggtttttgaaacctgcacaacaattattggatgagatatgtgatgttggtgttcgtgctgagaagattattgctgatgctgatgcatctttgatggaaactaatcatgttattggtggaatgataaatggtgttgatgatgaagatacacttggtggtgatggaaggaagaacaagtctagattattaacagtgcttgatgaggtttgcaggaggtacagacaatactatcagcagattcatgcagtaataacttcatttgaatatgttgccggcctcggtaacgcagctccgtatgcaagtttggctataaatgccatgtccaaacattttagattcttgaagaatgtgattaccgaccagcttcagtttatcggtaagtctaattatcatataagcaatagaaaggatgaatctcccaggtttcacaacggcgatggagccccttacagtcaaagtccagggtttatggaacacgtccaacaacctgtttggcgacctcaaagagggttgcccgagcgtgctgtcagtgtttttaggggatggttgtttgaacactttttgcatccttaccctagtgatactgacaagctaatgttggctaaacaaactggtctatctcgtaaccaggtgtctaattggtttataaatgcaagagtaaggctttggaaaccaatggtggaggaaatacacatgcttgaatcacagcaatctccaaaggaatcacaaagagatgaacatagtcgaaacaatttaagcgagaacaacattgctgagaatccatctacgtccacagacaagtttatcgatgttgcatataaacgcactagaaacgaacttcacaacatgtcagtgccgaatcatagtatcgcaagcaatcaacaggttggtaatgttggagtgagcatgatgaataatggtgcaacaagcaatggtgtatctctgacgctcggtcttcatcaaaatcatggaattgggttgtccgagcctttcaacatgagtgccgcgcagcgttttggtcttgcacatcaacctgatagttacgccgcgagcggttttcaattgcagaataggcaatttgggagagattttattggtgggcaacttttgcgtgactatgtaggatga

SEQ ID NO: 195 - protein, 516 aa, Arabidopsis thaliana
MAEEGFENYYHIPQQSRREKLRYLSQNQTSFIESSPTLNPSFSPLPSLYDPSLISPLDAINSNPFLYQMNHVYNHGGSNSNNNEVMLLKSEPLSLSLSSNKNNQNQMSAANFQRYGSVVDVSRNTVPLGPFTGYASVLKGSRFLKPAQQLLDEICDVGVRAEKIIADADASLMETNHVIGGMINGVDDEDTLGGDGRKNKSRLLTVLDEVCRRYRQYYQQIHAVITSFEYVAGLGNAAPYASLAINAMSKHFRFLKNVITDQLQFIGKSNYHISNRKDESPRFHNGDGAPYSQSPGFMEHVQQPVWRPQRGLPERAVSVFRGWLFEHFLHPYPSDTDKLMLAKQTGLSRNQVSNWFINARVRLWKPMVEEIHMLESQQSPKESQRDEHSRNNLSENNIAENPSTSTDKFIDVAYKRTRNELHNMSVPNHSIASNQQVGNVGVSMMNNGATSNGVSLTLGLHQNHGIGLSEPFNMSAAQRFGLAHQPDSYAASGFQLQNRQFGRDFIGGQLLRDYVG

SEQ ID NO: 196 - DNA, 1755 bp, Gnetum gnemon
atggatatgataaaaccagattttcaacaaatccgaagagataagtttagagttgagcaaatgaatgattttcccaacacttggactcagcagcagcatcagaacatcagaattcccaacaaccttgatttgattggtatcttacagaaccagatttccgtaccggttcaaaccgatttgtatcaagattctgccgcaacctttatgaacatgcctcagtcgatacatagagacccacaaggccctagtaattggagaatcagtgatttgtcacaacctagtaccgtgaatcacggatatgatcaggctggtattaggccaaacaacgttgcagatttgttgtccgatcatttcagttctcgaaaccaaatattggaccgtcctctttatgtcggccgggactctattcctcagtctagcatgattaggagaagtgaagtttcttgtctagacgataatcaaaagggttgtgtaacggtggcttgttcgggtactggtaatgagattttaaggagcagttatgatcaaggttcttcttctggaagttaccgaggagaattttcgtttctcccaagtttggagaatcaatcagttgcgcacaatgcaagcaactggaaccacggaccagtgaatgttactgccacttctcatactaatagtaagaaaggctttccactctcacttttgtctgatatccctccatctagagacgttggaaatgcagctgttttgtcaacaatgaatattcacggcccactcgggcctttcacgggatatgcatcgatactgaagagttcgaggttcttggagccggctcagaaaatgttagaagagttttgtatctcttatgcttcaaagattattagtagaagtgaatctacttccatggaggatgatgatgatgatgatgataacttgtcagggtttagtagttcttctgagccattagaacccaagaatagactaaagaaagcaaaacttctctttctgcaagaagaggtttgcaagtggtacaaactatataatcatcagttgcaaacagttatgtcttccttcaatacagtggctggtctaaacaccgcaacaccgtatatctcgttggctctcaaacggacttcacgaagtttcaaggcccttagaaccgcaatagctgaacatgtgaagcaaatctcaagtcactcatcaaacggtaacaacaacaaccgattccaaaagaggcaaagatctttgattggtaacaatgtcgggtttgaatctcaacaacaacatatctggaggcctcaaaggggattgcccgaacgtgcagtggctgttcttagagcatggctctttgaccattttcttcatccgtaccccactgattctgataagcagatgctagccactcaaactggtctctctcgtaaccaggtatcaaattggttcataaacgcccgtgtgcgattatggaaacctatggtggaagaaatacacacacttgagaccaaagcaattaaaaatgcagatactagtcacaacattgagccatcaaatagaccgaatactgttagcagtccgagccatgaacaaacgctaacgggcctctccgggacaaaacggtcgaggttagagtacatggacatggtggggttcaatagagggaacgtgtcactcacgttagagcttaggcgtggtgtggacaatgttatccaaacgcagactcaggatcatcagtttggaactggaagccaaatgtttcatgactttgtgggttga

SEQ ID NO: 197 - protein, 584 aa, Gnetum gnemon
MDMIKPDFQQIRRDKFRVEQMNDFPNTWTQQQHQNIRIPNNLDLIGILQNQISVPVQTDLYQDSAATFMNMPQSIHRDPQGPSNWRISDLSQPSTVNHGYDQAGIRPNNVADLLSDHFSSRNQILDRPLYVGRDSIPQSSMIRRSEVSCLDDNQKGCVTVACSGTGNEILRSSYDQGSSSGSYRGEFSFLPSLENQSVAHNASNWNHGPVNVTATSHTNSKKGFPLSLLSDIPPSRDVGNAAVLSTMNIHGPLGPFTGYASILKSSRFLEPAQKMLEEFCISYASKIISRSESTSMEDDDDDDDNLSGFSSSSEPLEPKNRLKKAKLLFLQEEVCKWYKLYNHQLQTVMSSFNTVAGLNTATPYISLALKRTSRSFKALRTAIAEHVKQISSHSSNGNNNNRFQKRQRSLIGNNVGFESQQQHIWRPQRGLPERAVAVLRAWLFDHFLHPYPTDSDKQMLATQTGLSRNQVSNWFINARVRLWKPMVEEIHTLETKAIKNADTSHNIEPSNRPNTVSSPSHEQTLTGLSGTKRSRLEYMDMVGFNRGNVSLTLELRRGVDNVIQTQTQDHQFGTGSQMFHDFVG

SEQ ID NO: 198 - DNA, 2643 bp, Oryza sativa
atgccactttacgacgcaagtatgatacctggttccgaaatgttcaatttctcggcggaagcagaacttttgagctttcaatcaaagaatttaagttcgcaacagtctgcttcaagcgaagacgctgtttcctgcagaccagtagctgcggggccgttcacgagctttgggcacactgtctccaaagacagtgttgtgtcaaacgttaccagctggaaaaactacagtgcgcaaggaagtgaagaatggcctggtagggtcattttgaatagtgtggggtacgaaggagggcaggattcccttgcaacgccacttatgctaggaggaagtgttaaggaagtagcagctcaggcggacgcaatgcgactctatttgatgaatccaggatacgatgcttattccgaagcgtcaacggctgcgcattcatcaaacaacattgcaaatcaaatacacgatgtccacaaacagattgttgaagttcctgctcattttcaatcttatattcagaatcatgctgtttcagtggttggggaaacctcacattccagtggaagccaatgggttagtggcacaaatgaactggctcttcttcccagttacagtgacattcaaaatgggcattatttgccatcatcgcgttactacggcattggaagctgggctaatcgccacaatgcgcttcaagattcataccaaggagccttcgtggaagggaaagttggggttgaggtaaggccgcagcagctttccatcgggcgcgatgggtgcgggccttccggccaaggactttctctgtctctttcgccccaccaaccctcagaggtgcctctgcaccaaattgatgcagtatgtaaccgtacgaacatcttacaattatctgctgatcagttaaaaggtaaatcagaagacgttcagagccggaacgagggggcacatggtcctcagggtcatccgtctccgtactcgcggcgtgtcctcagtagagtaggggcgcctatggatttgcaaatgaacgtgggaccattgggccctttcacaggttatgctaccattttgaagggctccaagtacttgaagccggcacagcagctgttagaggagttttgcaacgttggaaaggggctaaactaccagtgcaacccttcaaaacagaagcttttgggccatcacttgtctgcagagaaaagtttacccgacgccgtcattcctccaatcagtacaactgtgaaaggtgaagttgatggaaggaaggctagtgcctgtgcagcgtcttcatcaatgtctgtggttgacaaaacatcaagtgagcctgccatgggagagcaactggttatttctggcgctagattcgagatgcataagaagcggacgaggttgctagctttgcttgacgagttacaaaggagatacaggcagtacaatgatcaaatgcagatgatcattacatcttttgaatctgtaggtggcttgggagctgctgcaccttacacatctcttgcattgaaagcaatgtcaagacattttaaatgtttaaaagatgcaattggtgatcagctgaaggtgatcagcaaggctttaggtaacgagtcgtctcttccaggagtcagcgtaggggaaacgccaagactgaggttggtagatcaaggcatcagaaaccagcgcagtgtgcatcacctaggaatgcttgagcagcatgcatggcgcccccagagaggtcttcctgagcgtgcagtctcggttcttcgtgcatggctctttgaacattttttacacccgtaccccacagatgcggataagcacatgttggcgagacaaactggcctttctagaagtcaggtttctaattggtttattaacgcaagggtcggactttggaagcctatggtggaggaaatgtatgaactagagacgagggaagcatcgcaagtggatgcaccgcctggaaaaaccgatcgcgaggaaagagacactagtaaaggtggcattagcacagaaaaaaatgcatctgggcgtggcaaagtacttatggaaactatttcagagatgcagtcggtttctggttgtggaagcagttccaaattagaacaaacgaccagtacctcccaaaatggtcatgaaaattgtggtacatcagtgagcatccctttggagtcatcttatttgcatgctcatgaagcagatgctgcaagagagacagccgtgaacgttaataggcatttctctgggcaaacacagggaatgcccacgtcccattcagcgatttcaggcgtagaaagtgacagtggttatgctgatagctccggttttagttacgaacaggcaaccaagagactcagacaaggcctgggaaatactattgatttttcttcctacatgggtggaagaatttctcatgaaagcttgaatcccagaccaaccgggaacgctagtgtctctttaacattgggcctgcgtcacagtggtgcacaagaaaagtataccggtgctctctatttgcccagagaagatactcttcaaggctgcaattcccgttatgagatccatgaaatccatgacggtcataatcaggcatgcgtcggtggctttgaaactcatgatattcaatttagaaagcatcttattggaactcagcttcttcaatga

SEQ ID NO: 199 - protein, 880 aa, Oryza sativa
MPLYDASMIPGSEMFNFSAEAELLSFQSKNLSSQQSASSEDAVSCRPVAAGPFTSFGHTVSKDSVVSNVTSWKNYSAQGSEEWPGRVILNSVGYEGGQDSLATPLMLGGSVKEVAAQADAMRLYLMNPGYDAYSEASTAAHSSNNIANQIHDVHKQIVEVPAHFQSYIQNHAVSVVGETSHSSGSQWVSGTNELALLPSYSDIQNGHYLPSSRYYGIGSWANRHNALQDSYQGAFVEGKVGVEVRPQQLSIGRDGCGPSGQGLSLSLSPHQPSEVPLHQIDAVCNRTNILQLSADQLKGKSEDVQSRNEGAHGPQGHPSPYSRRVLSRVGAPMDLQMNVGPLGPFTGYATILKGSKYLKPAQQLLEEFCNVGKGLNYQCNPSKQKLLGHHLSAEKSLPDAVIPPISTTVKGEVDGRKASACAASSSMSVVDKTSSEPAMGEQLVISGARFEMHKKRTRLLALLDELQRRYRQYNDQMQMIITSFESVGGLGAAAPYTSLALKAMSRHFKCLKDAIGDQLKVISKALGNESSLPGVSVGETPRLRLVDQGIRNQRSVHHLGMLEQHAWRPQRGLPERAVSVLRAWLFEHFLHPYPTDADKHMLARQTGLSRSQVSNWFINARVGLWKPMVEEMYELETREASQVDAPPGKTDREERDTSKGGISTEKNASGRGKVLMETISEMQSVSGCGSSSKLEQTTSTSQNGHENCGTSVSIPLESSYLHAHEADAARETAVNVNRHFSGQTQGMPTSHSAISGVESDSGYADSSGFSYEQATKRLRQGLGNTIDFSSYMGGRISHESLNPRPTGNASVSLTLGLRHSGAQEKYTGALYLPREDTLQGCNSRYEIHEIHDGHNQACVGGFETHDIQFRKHLIGTQLLQ

SEQ ID NO: 200 - DNA, 1839 bp, Oryza sativa
atgtcgtccgccgctgggggcggcgggtacggcggcggccagggtggaggcgcggagcaccaccaccaccaccacgggcacgccggtcacctcctgctccaccaccatccgcagcacgtggccggcgcggccgttgcggcagcggccgcggcggcgggcgggcagatgtaccacgtgccccagcacagccggcgcgagaagctccggttcccgccggacgccggggactcgccaccgcctcatggtcatggtcatggtcatgccccgcagcagcagcagcagcacgggtcgtggcctccgcccccggcgttctactcgtacgcgtcctcgtcgtcgtcgtactccccgcacagccctactctagcgcaggcgcagctggtggcgcacgggctggcgccgccgctcccgcagatcccgacgcagaacttctcgctgtcgctctcctccgcgtcgtcgaatcctccaccaccgcaggcgcagccgaggaggcagctcggcggcctcgcgcaggccacggggccgttcggtcccttcaccggctacgccgccgtgctcggccggtcccgtttcctcggcccggcagagaagctgttcgaggagatctgcgacgtcggcggcgctgcttcgcacgtcgaccgcaccatctccgacgagggcctgctcgacgcggatccgatggacggcgtcgatcatgacgtcgttgatcacgacctcggcggcgctgaccgcgcagcggccgacgctggccccatctcgggggccgagcagcagtggaagaagacgaagctcatctccatgatggaagaggtttgcaagaggtaccggcagtactaccagcaggttcaggctgtgatggcctcgttcgagaccgtcgccgggttcagcaacgccgcgccgttcgcggcattggcgctgagggcgatggcgaagcacttcaagtgcttgaagagcatgattctgaaccagctgcgcaacacgagcaacaaggtcgctgtgaaggacgggctaaacaaggagatcgccgtgttcgggctcgccgggggtagcagcggcggcgccggcctccagcgagcgaacagcgcgagcgcgttcggccagccgcacaatatttggcgcccacagagggggctccccgagcgcgctgtgtccgttctacgcgcgtggctgttcgaacacttcctgcacccgtatcctaccgatggtgataagcaaatgctagcaaaacaaacaggcttgacacgcaaccaggtatcgaactggtttatcaacgcaagggttaggttgtggaagccaatggtggaagaaattcacaacctagagatgaggcaaatgcacaagcactcggtggttgacaagggccagcatagcgtgcatcatcaggcccagcattcttcgcagtgcagcgggaatccctccgttccttcggactcccatcctggacagagcagcagcataacccggaaccacaacaccgctgcctcccagggcttcccggatgagctctcccagatgtcccagtccatccagggacaggtgagcttcgcatacaacgggctgacctcgcagcacaacattgcatcaccacatcatcagcaccagcaggtcggcggtgttggtatcggaggcagcaatggcggtgtctccctcacccttggtcttcaccagaacaacagggtctgcatcgccgagcctctcccggctgctctcccggccaacctagctcaccgtttcggactggaggaagtcagtgacgcctatgtgatgagctcatttggaggtcaggaccggcatttcgggaaggagattggtggtcacttgctgcatgattttgtcgggtga

SEQ ID NO: 201 - protein, 612 aa, Oryza sativa
MSSAAGGGGYGGGQGGGAEHHHHHHGHAGHLLLHHHPQHVAGAAVAAAAAAAGGQMYHVPQHSRREKLRFPPDAGDSPPPHGHGHGHAPQQQQQHGSWPPPPAFYSYASSSSSYSPHSPTLAQAQLVAHGLAPPLPQIPTQNFSLSLSSASSNPPPPQAQPRRQLGGLAQATGPFGPFTGYAAVLGRSRFLGPAEKLFEEICDVGGAASHVDRTISDEGLLDADPMDGVDHDVVDHDLGGADRAAADAGPISGAEQQWKKTKLISMMEEVCKRYRQYYQQVQAVMASFETVAGFSNAAPFAALALRAMAKHFKCLKSMILNQLRNTSNKVAVKDGLNKEIAVFGLAGGSSGGAGLQRANSASAFGQPHNIWRPQRGLPERAVSVLRAWLFEHFLHPYPTDGDKQMLAKQTGLTRNQVSNWFINARVRLWKPMVEEIHNLEMRQMHKHSVVDKGQHSVHHQAQHSSQCSGNPSVPSDSHPGQSSSITRNHNTAASQGFPDELSQMSQSIQGQVSFAYNGLTSQHNIASPHHQHQQVGGVGIGGSNGGVSLTLGLHQNNRVCIAEPLPAALPANLAHRFGLEEVSDAYVMSSFGGQDRHFGKEIGGHLLHDFVG

SEQ ID NO: 202 - DNA, 1038 bp, Oryza sativa
atggtggccagcaagcagctccactcgcagcgatgtggcggccactactgccagctgcaccaccaccggccggaggagatcgccggcgccggtgccgagagacaccggagggacgggtcgagcggctgcggcggcgctggtccgatggtcgtgctgaccctcgggtccggcgccgcggcggctgaagacaacggtggcggccgctcgcgctgctgctgcggtgccggtggcgccgcgccggcgacgatggtttccccgttgcgtggttcgaggtacctgctgccggcgcaggagctgctccgcgaggcggtgtccgccgccgccgccagcgcgcgaggtggcgacgacgacgacgaggcggtggcgagcttcccgcacgacggcaagagcaccggcattggcggcggcggcggcgtccaagccaagctcctcagccttctcagcgagctggagagccggcacgagcactacttcggggagctgaggcgggtgtcggcgtcgttcgagccggcgctgggcgccggcgccacggccgggtacacggcgctcatggcgcaggccatgtcgcgccacttcggcagcctgcgccgcgccatactgcgcaagctcaggctccacgccgccgcggcggccaggacgaggtcggcgttgctgcggctggtccgggacgccatggaggaggacgacgagggcgacggcgaggaggaggaggaggtggtgaacagggtggtccggcggacgaagcaggcggcggcggcgagggcggagcaggcgtggaggccgctccggggattgccggaggacgccgtgggcgtgctccgggcatggctcttcgaccatttcctccacccgtatccgaatgacaacgagaagctcatgctggccgtggctacgggtctaagcagaacccaaatatcgaactggttcatcaacgcgcgagtgcggctgtggaagcccatggtggaggagatgtacaacgacgagttcgacgacgacgacgccggcagcggcggcggcggcgcttcgtcctcctcgtga

SEQ ID NO: 203 - protein, 345 aa, Oryza sativa
MVASKQLHSQRCGGHYCQLHHHRPEEIAGAGAERHRRDGSSGCGGAGPMVVLTLGSGAAAAEDNGGGRSRCCCGAGGAAPATMVSPLRGSRYLLPAQELLREAVSAAAASARGGDDDDEAVASFPHDGKSTGIGGGGGVQAKLLSLLSELESRHEHYFGELRRVSASFEPALGAGATAGYTALMAQAMSRHFGSLRRAILRKLRLHAAAAARTRSALLRLVRDAMEEDDEGDGEEEEEVVNRVVRRTKQAAAARAEQAWRPLRGLPEDAVGVLRAWLFDHFLHPYPNDNEKLMLAVATGLSRTQISNWFINARVRLWKPMVEEMYNDEFDDDDAGSGGGGASSSS

SEQ ID NO: 204 - DNA, 1803 bp, Oryza sativa
atgtcgtccgccgcggggggaggaggagggtacgggggcggaggcggcgagcatcagcatcagcagcagcaccaccacctgctgcttgggcaggcggcggggcagctgtaccacgtgccgcagcacagccggcgggagaagctgcggttcccgcccgaccacccggcggagtcgccgccgccgccgccgcccgggtcgtggccgctgcccccggcgttctactcctacgcgtcgtcctcgtcatcgtactcgccgcacagcccgacgctggcgcactcgcagttggtggcgcatgggatgccgccgggggccgcgacgagcggaggggcccagatcccgagccagaacttcgcgctgtcgctgtcgtcggcgtcctcgaaccctccgcccacgccgaggaggcagtttggcggcggcggcggcggggccgccgggccgtacgggcccttcacgggctacgccgccgtgctcgggcggtccaggttcttgggccccgcgcagaagctgctcgaggagatctgcgacgtcggcggccgccccgcgcagcttgacaggggctccgacgagggtttgctcgacgtagacgccatggaggccgcgggaagcgtcgaccacgagatggacggcagcgatcgcgccgtcgcggacgcggtcacggtctccggcgccgagcagcagtggaggaagactaggctcatctcgcttatggaagacttcaaggctcttttaagctcccttctaaaactagcaggaggtgatccgcagtttatctataatcaaaaggtttgcaagcgatacaggcaatactaccagcaactccaagctgtagtatcgtcctttgagactgttgcgggtctgagcaatgctgctccttttgcttccatggctcttaggacaatgtcgaagcatttcaagtatttgaagggcattatactgaaccagctgcgcaatacgggcaagggtgctacaaaagatggtctcggcaaggaagacacagcaaactttgggcttatgggcggcggcgctggcctactaaggggaaacaatgtgaattcgtttagccaacctcacaacatatggcgcccgcaaagagggctacctgagcgtgctgtttcggttcttcgtgcatggctattcgaacacttcctgcacccgtatccaactgacagcgataagcagatgcttgctaaacagacaggattaactaggaaccaggtatcgaactggtttatcaatgcaagggttaggctctggaagccaatggttgaagaaattcacaacctcgagatgaggcagctgaagaatccgtctcttgacaagaatcagctctccatgcagcacacccaacattcgtcggacagcagcgggaagccctgtgatccatcaaactcgctgcaaggacaaagtagcagcatgaccaggaatcacagcatctccgcctcccggcacatcgaggacggcctctcccagatgccccatgacatctccggtcaggtgagcttcgcatacaacgggctcgccgcgcatcacagcatcgcgatggcgcaccaccaccaacctgacctcattggcaccggtggtgccgcgaatgctggcggtgtctcactcacccttggccttcaccagaacaataaccgagcttacattgctgagccccttccggccgcgcttccgctcaatcttgcccatcgtttcggactggaggacgttagtgatgcctacgtgatgagctcatttggtggtcaggaccggcatttcaccaaggagatcggtggccatttgctccatgactttgttggttga

SEQ ID NO: 205 - protein, 600 aa, Oryza sativa
MSSAAGGGGGYGGGGGEHQHQQQHHHLLLGQAAGQLYHVPQHSRREKLRFPPDHPAESPPPPPPGSWPLPPAFYSYASSSSSYSPHSPTLAHSQLVAHGMPPGAATSGGAQIPSQNFALSLSSASSNPPPTPRRQFGGGGGGAAGPYGPFTGYAAVLGRSRFLGPAQKLLEEICDVGGRPAQLDRGSDEGLLDVDAMEAAGSVDHEMDGSDRAVADAVTVSGAEQQWRKTRLISLMEDFKALLSSLLKLAGGDPQFIYNQKVCKRYRQYYQQLQAVVSSFETVAGLSNAAPFASMALRTMSKHFKYLKGIILNQLRNTGKGATKDGLGKEDTANFGLMGGGAGLLRGNNVNSFSQPHNIWRPQRGLPERAVSVLRAWLFEHFLHPYPTDSDKQMLAKQTGLTRNQVSNWFINARVRLWKPMVEEIHNLEMRQLKNPSLDKNQLSMQHTQHSSDSSGKPCDPSNSLQGQSSSMTRNHSISASRHIEDGLSQMPHDISGQVSFAYNGLAAHHSIAMAHHHQPDLIGTGGAANAGGVSLTLGLHQNNNRAYIAEPLPAALPLNLAHRFGLEDVSDAYVMSSFGGQDRHFTKEIGGHLLHDFVG

SEQ ID NO: 206 - DNA, 1839 bp, Oryza sativa; identical to SEQ ID NO: 192

SEQ ID NO: 207 - protein, 612 aa, Oryza sativa; identical to SEQ ID NO: 193

SEQ ID NO: 208 - DNA, 1041 bp, Oryza sativa
atggtggccagcaagcagctccactcgcagcgatgtggcggccactactgccagctgcaccaccaccggccggaggagatcgccggcgccggtgccgagagccaccggagggacgggtcgagcggctgcggcggcgctggtccgatggtcgtgctgaccctcgggtccggcgccgcggcggctgaagacgacggtggcggccgctcgcgctgctgctgcggtgccggtggcgccgcgccggcgacgatggtttccgcgttgcgtggttcgaggtacctgctgccggcgcaggagctgctccgcgaggcggtgtccgccgccgccgccagcgcgcgaggtggcgacgacgacgacgaggcggtggcgagcttcccgcacgacggcaagagcaccggcattggcggcggcggcggcggcgtccaagccaagctcctcagccttctcagcgagctggagagccggcacgagcactacttcggggagctgaggcgggtgtcggcgtcgttcgagccggcgctgggcgccggcgccacggccgggtacacggcgctcatggcgcaggccatgtcgcaccacttcggcagcctgcgccgcgccatactgcgcaagctcaggctccacgccgccgcggcggccaggacgaggtcggcgttgctgcggctggcccgggacgccatggaggaggacgacgagggcgacggcgaggaggaggaggaggtggtgaacagggtggtccggcggacgaagcaggcggcggcggcgagggcggagcaggcgtggaggccgctccggggattgccggaggacgccgtgggcgtgctccgggcatggctcttcgaccatttcctccacccgtatccgaatgacaacgagaagctcatgctggccgtggctacgggtctaagcagaacccaaatatcgaactggttcatcaacgcgcgagtgcggctgtggaagcccatggtggaggagatgtacaacgacgagttcgacgacgacgacgccggcagcggcggcggcggcgcttcgtcctcctcgtga

SEQ ID NO: 209 - protein, 346 aa, Oryza sativa
MVASKQLHSQRCGGHYCQLHHHRPEEIAGAGAESHRRDGSSGCGGAGPMVVLTLGSGAAAAEDDGGGRSRCCCGAGGAAPATMVSALRGSRYLLPAQELLREAVSAAAASARGGDDDDEAVASFPHDGKSTGIGGGGGGVQAKLLSLLSELESRHEHYFGELRRVSASFEPALGAGATAGYTALMAQAMSHHFGSLRRAILRKLRLHAAAAARTRSALLRLARDAMEEDDEGDGEEEEEVVNRVVRRTKQAAAARAEQAWRPLRGLPEDAVGVLRAWLFDHFLHPYPNDNEKLMLAVATGLSRTQISNWFINARVRLWKPMVEEMYNDEFDDDDAGSGGGGASSSS

SEQ ID NO: 210 - DNA, 1743 bp, Oryza sativa
atgtcgtccgccgcggggggaggaggagggtacgggggcggaggcggcgagcatcagcatcagcagcagcagcaccacctgctgcttgggcaggcggcggggcagctgtaccacgtgccgcagcacagccggcgggagaagctgcggttcccgcccgaccacccggcggagtcgccgccgccgccgccgcccgggtcgtggccgctgcccccggcgttctactcctacgcgtcgtcctcgtcatcgtactcgccgcacagcccgacgctggcgcacgcgcagttggtggcgcatgggatgccgccgggggccgcgacgagcggaggggcccagatcccgagccagaacttcgcgctgtcgctgtcgtcggcgtcctcgaaccctccgcccacgccgaggaggcagtttggcggcggcggcggcggcggcggggccgccgggccgtacgggcccttcacgggctacgccgccgtgctcgggcggtccaggttcttgggccccgcgcagaagctgctcgaggagatctgcgacgtcggcggccgccccgcgcagcttgacaggggctccgacgagggtttgctcgacgtagacgccatggacgccgcgggaagcgtcgaccacgagatggacggcagcgatcgcgccgtcgcggacgcggtcacggtctccggcgccgagcagcagtggaggaagactaggctcatctcgcttatggaagacgtttgcaagcgatacaggcaatactaccagcaactccaagctgtagtatcgtcctttgagactgttgcgggtctgagcaatgctgctccttttgcttccatggctcttaggacaatgtcgaagcatttcaagtatttgaagggcattatactgaaccagctgcgcaatacgggcaagggtgctacaaaagatggtctcggcaaggaagacacaacaaactttgggcttatgggcggcggcgctggcctactaaggggaaacaatgtgaattcgtttagccaacctcacaacatatggcgcccgcaaagagggctaccagagcgtgctgtttcggttcttcgtgcatggctattcgaacacttcctgcacccgtatccaactgacagcgataagcagatgcttgctaaacagacaggattaactaggaaccaggtatcgaactggtttatcaatgcaagggttaggctctggaagccaatggttgaagaaattcacaacctcgagatgaggcagctgcagaagaatccgtctcttgacaagaatcagctctccatgcagcacacccaacattcgtcggacagcagcgggaagccctgtgatccatcaaactcgctgcaagggcaaagtagcagcatgaccaggaatcacagcatctccgcctcccggcacatcgaggacggcctctcccagatgccccatgacatctccggtcaggtgagcttcgcatacaacgggctcgccgcgcatcacagcatcgcgatggcgcaccaccaccaacctgacctcattggcaccggtggtgccgcgaatgctggcggtgtctcactcacccttggccttcaccagaacaataaccgagcttacattgctgagccccttccggccgcgcttccgctcaatcttgcccatcgtttcggactggaggacgttagtgatgcctacgtgatgagctcatttggtggtcaggaccggcatttcaccaaggagatcggtggccatttgctccatgactttgttggttga

SEQ ID NO: 211 - protein, 580 aa, Oryza sativa
MSSAAGGGGGYGGGGGEHQHQQQQHHLLLGQAAGQLYHVPQHSRREKLRFPPDHPAESPPPPPPGSWPLPPAFYSYASSSSSYSPHSPTLAHAQLVAHGMPPGAATSGGAQIPSQNFALSLSSASSNPPPTPRRQFGGGGGGGGAAGPYGPFTGYAAVLGRSRFLGPAQKLLEEICDVGGRPAQLDRGSDEGLLDVDAMDAAGSVDHEMDGSDRAVADAVTVSGAEQQWRKTRLISLMEDVCKRYRQYYQQLQAVVSSFETVAGLSNAAPFASMALRTMSKHFKYLKGIILNQLRNTGKGATKDGLGKEDTTNFGLMGGGAGLLRGNNVNSFSQPHNIWRPQRGLPERAVSVLRAWLFEHFLHPYPTDSDKQMLAKQTGLTRNQVSNWFINARVRLWKPMVEEIHNLEMRQLQKNPSLDKNQLSMQHTQHSSDSSGKPCDPSNSLQGQSSSMTRNHSISASRHIEDGLSQMPHDISGQVSFAYNGLAAHHSIAMAHHHQPDLIGTGGAANAGGVSLTLGLHQNNNRAYIAEPLPAALPLNLAHRFGLEDVSDAYVMSSFGGQDRHFTKEIGGHLLHDFVG

SEQ ID NO: 212 - DNA, 1839 bp, Oryza sativa; identical to SEQ ID NO: 192

SEQ ID NO: 213 - protein, 612 aa, Oryza sativa; identical to SEQ ID NO: 193

SEQ ID NO: 214 - DNA, 1041 bp, Oryza sativa; identical to SEQ ID NO: 208

SEQ ID NO: 215 - protein, 346 aa, Oryza sativa; identical to SEQ ID NO: 209

SEQ ID NO: 216 - DNA, 1743 bp, Oryza sativa; identical to SEQ ID NO: 210

SEQ ID NO: 217 - protein, 580 aa, Oryza sativa; identical to SEQ ID NO: 211

SEQ ID NO: 218 - DNA, 1839 bp, Oryza sativa
atgtcgtccgccgctgggggcggcgggtacggcggcggccagggtggaggcgcggagcaccaccaccaccaccacgggcacgccggtcacctcctgctccaccaccatccgcagcacgtggccggcgcggccgttgcggcagcggccgcggcggcgggcgggcagatgtaccacgtgccccagcacagccggcgcgagaagctccggttcccgccggacgccggggactcgccaccgcctcatggtcatggtcatggtcatgccccgcagcagcagcagcagcacgggtcgtggcctccgcccccggcgttctactcgtacgcgtcctcgtcgtcgtcgtactccccgcacagccctactctagcgcaggcgcagctggtggcgcacgggctggcgccgccgctcccgcagatcccgacgcagaacttctcgctgtcgctctcctccgcgtcgtcgaatcctccaccaccgcaggcgcagccgaggaggcagctcggcggcctcgcgcaggccacggggccgttcggtcccttcaccggctacgccgccgtgctcggccggtcccgtttcctcggcccggcagagaagctgttcgaggagatctgcgacgtcggcggcgctgcttcgcacgtcgaccgcaccatctccgacgagggcctgctcgacgcggatccgatggacggcgtcgatcatgacgtcgttgatcacgacctcggcggcgctgaccgcgcagcggccgacgctggccccatctcgggggccgagcagcagtggaagaagacgaagctcatctccatgatggaagaggtttgcaagaggtaccggcagtactaccagcaggttcaggctgtgatggcctcgttcgagaccgtcgccgggttcagcaacgccgcgccgttcgcggcattggcgctgagggcgatggcgaagcacttcaagtgcttgaagagcatgattctgaaccagctgcgcaacacgagcaacaaggtcgctgtgaaggacgggctaaacaaggagatcgccgtgttcgggctcgccgggggtagcagcggcggcgccggcctccagcgagcgaacagcgcgagcgcgttcggccagccgcacaatatttggcgcccacagagggggctccccgagcgcgctgtgtccgttttacgcgcgtggctgttcgaacacttcctgcacccgtatcctaccgatggtgataagcaaatgctagcaaaacaaacaggcttgacacgcaaccaggtatcgaactggtttatcaacgcaagggttaggttgtggaagccaatggtggaagaaattcacaacctagagatgaggcaaatgcacaagcactcggtggttgacaagggccagcatagcgtgcatcatcaggcccagcattcttcgcagtgcagcgggaatccctccgttccttcggactcccatcctggacagagcagcagcataacccggaaccacaacaccgctgcctcccagggcttcccggatgagctctcccagatgtcccagtccatccagggacaggtgagcttcgcatacaacgggctgacctcgcagcacaacattgcatcaccacatcatcagcaccagcaggtcggcggtgttggtatcggaggcggcaatggcggtgtctccctcacccttggtcttcaccagaacaacagggtctgcatcgccgagcctctcccggctgctctcccggccaacctagctcaccgtttcggactggaggaagtcagtgacgcctatgtgatgagctcatttggaggtcaggaccggcatttcgggaaggagattggtggtcacttgctgcatgattttgtcgggtga

SEQ ID NO: 219 - protein, 612 aa, Oryza sativa; identical to SEQ ID NO: 193

SEQ ID NO: 220 - DNA, 1743 bp, Populus trichocarpa; identical to SEQ ID NO: 210

SEQ ID NO: 221 - protein, 580 aa, Populus trichocarpa; identical to SEQ ID NO: 211

SEQ ID NO: 222 - DNA, 2508 bp, Populus trichocarpa
atggaaacaagaagttttaggcctgaatcacatgtagcacagcaaagccggagagataagttgagaggtcaacagagtttaacctcagttcagtatttagatgactaccctaacagtttggaacgtatatctgtcagtccagggctaagcccagatcttgttcacgttcgaaataataggaatgacaatacgatttatgattccactatgttttcctcagaaattctcaattttgcaacaagttctcatgttctatcagctcctaaagtttcaattgttgatcaagaactaggtgcagttccgctcaataggcctatacttgccgaggattcttctttcactggtatgacgtctcacccagttttatccaacttcaatgcttcacacaaggccagtagctgtgacccacaaggttgtggtaattggagaagccttgactcacagcaaagttatgatttgatggtgaattatgcaggtggatcagtaggtggggaaagaaatcagaaacctatgtttgttggggaagtcttgtcaaataatgcaagggtaagcaacatttcaacatctagacaatatttgatgcctggttacaatggaaaccagaatgttcagcttccatctacgttaagaaatacctttggtgaaatttcaagtgaagatagcatcaagcagttgagggtgatgcaggttccttctcttccaccataccaaaacgcagcccaagatgtcattccttctggttgttttaggcccagaatgaatgaacgcattctccatccatcttttgtaactgaatcaactgcttcacattttgataataatggcagtacttggatgagcagaccacttgagaactaccatcactggagtactggtgagttgggtcttgttgaaaggacgagtgaccaagagatgatgactattacaagtgatgctaatactcagggtttatctttgtcgctttcatcaattaatccaccatctaaagttgaagttacccattttggagaggaatatgcatctgaacatttgcaattgaaggtggctgatcgtgtttcccaagaatctcatcaagattcaaaattttctaagtcaagttctctgtgtgctttgccgaagccatcaattataactaaaagttgtggaaaatcgattcatgacatcgtggggacttctacgcatgctcttcgcaacactggtcctcttggacctttcactggatatgcaactattctaaagagttcaaaattcttgaagccagctcagcaactgctggaagaattctctagtagaacaggtccaaaactcacgagaatatttgagatgtctgaagatcaagttactgctccagctttggctgacattgttaatgaagccaatgaaaattctggaactaacgccaagaattactcaggcatcccatcctctacattttactgttcaaataaggcaagtggtggtgatgatgtaggtggaagcggcggctcttgtggatcttatgggccagaataccaacaaaagaaggcaaagctcctgttcttgcaagaggaggtttgcagaaggtacaagcaatatcatcaacagatgcaaatggtagcttcttcttttgaatcagtggctagtctcagtgctgccaccccgtatgtttccttggctctcaagacagtctctagcaatttcaggtctctgaaacatggcatctcagaccaactcaagctcgtgacgaaagccctaggagacgatcttttctcccggaatacagttgcagtgggtagtaagggtgatacaattacatcaaggtcaatatacatggatcaaagcattcaaaagaacaaatctggtggggttagtgtgggttaccatgaaccccaacaacacatatggaggccccaaagaggcctaccagaacgttcagttgcaattcttagagcttggctgtttgagcattttctacacccgtaccccacagacactgataagcacatgttagctacgcggacaggtctatctcgaaaccaggtgtcaaattggttcattaatgcccgcgttcgcgtgtggaaacctatggttgaggaaatacatatgcttgaaacaaaaggcttggcagaaatttctggaaagaatgatggaaattctccagagggtaatatccagtcaaatgatgaacaaacctcaaacaaacttggtaaaaattccatgctaaataaacaattggaatgctctggtattggttcctctggaagcagcggtgaacaactggatgaggagcaatggagtgaagggaagaggtcaagagtagaatttcaggttcccaccaccatggatggatcattgatgaattttctgccgtatcagagaagtggtattgataatggtggagctgtttcccttactttgggtctcaggcaaggtattgaaagtgcgcagcaccaaatacaattgcaacaacacaatggtcagtttaagcagtcatttggaggtcagatgattcatgattttgtcggttga

SEQ ID NO: 223 - protein, 835 aa, Populus trichocarpa
METRSFRPESHVAQQSRRDKLRGQQSLTSVQYLDDYPNSLERISVSPGLSPDLVHVRNNRNDNTIYDSTMFSSEILNFATSSHVLSAPKVSIVDQELGAVPLNRPILAEDSSFTGMTSHPVLSNFNASHKASSCDPQGCGNWRSLDSQQSYDLMVNYAGGSVGGERNQKPMFVGEVLSNNARVSNISTSRQYLMPGYNGNQNVQLPSTLRNTFGEISSEDSIKQLRVMQVPSLPPYQNAAQDVIPSGCFRPRMNERILHPSFVTESTASHFDNNGSTWMSRPLENYHHWSTGELGLVERTSDQEMMTITSDANTQGLSLSLSSINPPSKVEVTHFGEEYASEHLQLKVADRVSQESHQDSKFSKSSSLCALPKPSIITKSCGKSIHDIVGTSTHALRNTGPLGPFTGYATILKSSKFLKPAQQLLEEFSSRTGPKLTRIFEMSEDQVTAPALADIVNEANENSGTNAKNYSGIPSSTFYCSNKASGGDDVGGSGGSCGSYGPEYQQKKAKLLFLQEEVCRRYKQYHQQMQMVASSFESVASLSAATPYVSLALKTVSSNFRSLKHGISDQLKLVTKALGDDLFSRNTVAVGSKGDTITSRSIYMDQSIQKNKSGGVSVGYHEPQQHIWRPQRGLPERSVAILRAWLFEHFLHPYPTDTDKHMLATRTGLSRNQVSNWFINARVRVWKPMVEEIHMLETKGLAEISGKNDGNSPEGNIQSNDEQTSNKLGKNSMLNKQLECSGIGSSGSSGEQLDEEQWSEGKRSRVEFQVPTTMDGSLMNFLPYQRSGIDNGGAVSLTLGLRQGIESAQHQIQLQQHNGQFKQSFGGQMIHDFVG

SEQ ID NO: 224 - DNA, 2163 bp, Populus trichocarpa
atggttgatcaagaactaggtccagcacacctccatagccccattgcagctgatgattcttcgttcaccaacatgcctcacccagttttgtcaaacttaaacgcttcacctacagccagtaatggtgatgctcaaggatgtggcaactggacaaagctaggttcagagcaaggttatgatttgactgttgattacacaggtgggtcggttgttggggagaggaatcagaaactgatgtctgctgtggaagtcctgtcaaataatgcaagggtaaccgacatttctacgtatacacaatatttcaagcctagttacaatgaataccgagattttgagcttcaatcttctctagccgacccctcagatgagttttctagtcaagataaccaaaagcagctcagggaaaggcagtttaccactcatccacttcaccaaaatacactgcaagatgttgttacatcaggattggttgggagaactagagaaattattctccatccatcgtttgaaaatcaatcatccactttacattttaatgaccccaatgcttggataagaaggccgaatgagaactctcatcagtggagttgtgagttgggtcttattacaaggaagagttcccaagagctgaggactattccaaacgatgctaatactcaaggcttatctttgtctctttcgtcaaatcagtcatctaaagtcaatgaaactcggtttggagaagcatatgaatctgagtgtttgcaatcaaagaatggtctttccaaagaacctcatcatgtttcaaaagtttccaaggcaagttatatgtgtccattgccaaggccatcaattctaagtaaaggttgcggaaaatctttacatgacttaccaggagatgctacaaatattcttcgaaatgctggtcctcttggacctttcactggatatgcaactattctaagtagctctagattcttaaagccagctcaagagctaatggacgaattctgtggtgttaagggtctggggctcataagaacatctgagttgcccaagaggataggtggagaagctagtcctccagctttgggagactctgttaatgaagctgatacaggggacgaagctaatgatgacaataatttaggtgcctcaccctttacttctcgtagatcaaatgaagaaattggtcattgtggggtaggaaacagttcttcaaaaccttatatgccagagtaccaacaaatgaaggcaaagctcctatatttgcaggatgaggttctcagaaggtacaagcaatatcatcagcagatggaaatggttgcttcattttttgaatcagttgctggtcttagtgctgccacccagtacatttccatggctgtaaaggcagtctcagggaattttaggtccataaaacattgcatctctgatcagctcaagcatgtcacaaaagccctaggagagaatctgttctccccaaatacatttggaagcagaaccgcggggagcttaagatacaaggatcaaagctttcaaaagaacaactctggtgggccaaatgtgggttaccttgagccccaagaacacatctggaggcctcaaagaggcctaccagaacgtgcagtagtgattctcagagcttggctgtttgagcattttcttcacccataccctactgacacagataagcacatgctagccactcaaacaggtctatctcgataccaggtgtcaaattggttcataaatgcccgggtgcgcctttggaaaccaatggttgaagaaatacacactcttgaaaccaaaggtttgctggaaaacaatcgaagttccgggaagaatggtgggaattctgctgagggtgccagccagccagatggtgatcaccgagcctccaaagagctaggtacaagttacatgcctagtaaacaattggaatgctctagcaatattggctcctcagggggcagtagagatcaactagatgccgagcattggaatcaagagaagagatcgagagtggaatctcaggctccgatacatgcagatagatcgttgatgaattttatgctctatcaaaaacctgggagtgaaaatgggggccttggcgcggtttcacttacattgggtctcagacatggtgctgaaaatgctcaacatgaacaattgcaacagtga

SEQ ID NO: 225 - protein, 720 aa, Populus trichocarpa
MVDQELGPAHLHSPIAADDSSFTNMPHPVLSNLNASPTASNGDAQGCGNWTKLGSEQGYDLTVDYTGGSVVGERNQKLMSAVEVLSNNARVTDISTYTQYFKPSYNEYRDFELQSSLADPSDEFSSQDNQKQLRERQFTTHPLHQNTLQDVVTSGLVGRTREIILHPSFENQSSTLHFNDPNAWIRRPNENSHQWSCELGLITRKSSQELRTIPNDANTQGLSLSLSSNQSSKVNETRFGEAYESECLQSKNGLSKEPHHVSKVSKASYMCPLPRPSILSKGCGKSLHDLPGDATNILRNAGPLGPFTGYATILSSSRFLKPAQELMDEFCGVKGLGLIRTSELPKRIGGEASPPALGDSVNEADTGDEANDDNNLGASPFTSRRSNEEIGHCGVGNSSSKPYMPEYQQMKAKLLYLQDEVLRRYKQYHQQMEMVASFFESVAGLSAATQYISMAVKAVSGNFRSIKHCISDQLKHVTKALGENLFSPNTFGSRTAGSLRYKDQSFQKNNSGGPNVGYLEPQEHIWRPQRGLPERAVVILRAWLFEHFLHPYPTDTDKHMLATQTGLSRYQVSNWFINARVRLWKPMVEEIHTLETKGLLENNRSSGKNGGNSAEGASQPDGDHRASKELGTSYMPSKQLECSSNIGSSGGSRDQLDAEHWNQEKRSRVESQAPIHADRSLMNFMLYQKPGSENGGLGAVSLTLGLRHGAENAQHEQLQQ

SEQ ID NO: 226 - DNA, 2508 bp, Sorghum bicolor; identical to SEQ ID NO: 222

SEQ ID NO: 227 - protein, 835 aa, Sorghum bicolor; identical to SEQ ID NO: 223

SEQ ID NO: 228 - DNA, 1065 bp, Sorghum bicolor
atggcgaagcagcagcagcatgacaaggggtcgccaaagcaagctcgcaacgagcccgcgccacccccacagccggcgccgttccggttggagcattgctgccactgcgacggtgcccacggtcaggccgacgacgggcccaacggtgctggcccactgcacctgactctcggcccggccgccgaccgccgccgccgctgctcgtgcggtgtcgcgccggcgccggcggcgcccgtgactgtcgccgtgctccgcgggtcccggtacctgaggccggcgcaggagctgctgggcgacgtcgtgcgcgtggccgacctggcggctggcgacgacgaggacgaggatcaggctgatgcggaccggctcgagggcggtggtcgtcaccggtcgctgcgtcgggccgccgggaacgacggcgacggcgtccaggacaagctcctcggcctgctcagcgagctggagagccggcgggagcgctacttcggcgagctggggcgcgtggtgtcgtcgttcgagccggcgctgggcgacggcgcggcggcggcgtacacgtcgctgatggcgcgggccatggcgcgccacttcggcaacctgcgccgcgccatactgcgcaggctcaggctccacgccgccgccgcggcgaggaggtctctgcggcgtggcgtcgaggccggggaccacgaccacgacgaggacgaggacgaggatggggacgaggaggtgaccgaggagctggtggagagggtggcccggcggacgaagctggccgcggcggcgcgggcggagcaggcgtcgtggcggccgctccgtggcctgcccgacggctccgtggccgtgctccgggcgtggctcttcgaccatttcctccacccgtaccccgacgacggtgagaagctgaggctggcggtgaccaccggcttaagcaggcgccagatatccaactggttcatcaacgcgcgcgtgcggctgtggaagcccatgatcgaggagatgtaccaggacgagttcaccgagggttccgccgtctccagggacgacgacgccagcgcctcctcctcttcttga

SEQ ID NO: 229 - protein, 354 aa, Sorghum bicolor
MAKQQQHDKGSPKQARNEPAPPPQPAPFRLEHCCHCDGAHGQADDGPNGAGPLHLTLGPAADRRRRCSCGVAPAPAAPVTVAVLRGSRYLRPAQELLGDVVRVADLAAGDDEDEDQADADRLEGGGRHRSLRRAAGNDGDGVQDKLLGLLSELESRRERYFGELGRVVSSFEPALGDGAAAAYTSLMARAMARHFGNLRRAILRRLRLHAAAAARRSLRRGVEAGDHDHDEDEDEDGDEEVTEELVERVARRTKLAAAARAEQASWRPLRGLPDGSVAVLRAWLFDHFLHPYPDDGEKLRLAVTTGLSRRQISNWFINARVRLWKPMIEEMYQDEFTEGSAVSRDDDASASSSS

SEQ ID NO: 230 - DNA, 1782 bp, Sorghum bicolor
atgtcgtccgccgcgggcgggtacggcggcggtgcggggagcggcgccgagccccactgccacggccacggccacggcgacttcatgctgcaccaccatgcacagcatatcgccgcccagcagctctaccacgtgccgcagcacagccgtcgcgagaagctacggtttccgccggacgactcgcccccacacgcctccgcttccgccccgcagcagcagcacgccggggtggcctggccgcctccgccgccgccgccggcgttctactcctacgcgtcctcctccacgtcgtcctactccccgcacagccccacgctggcgcaggcgcagctcgtcgtggcgcacggcctcgccccgccgccgctctcgtcgcagatcccgacgcagaacttcgcgctctcgctctcgtcctcgtcctcgaacccaccgcccgcgccgcccccgcagcagaggagggcgcacgccgcgccctcggcgcccttcgggcccttcactggctacgcggccgtgctcgggcgctcccgtttcctcggccctgcggagaagctgctcgaggagatctgcgatgtcgggggcgccgcctcgcacgtggaccggagcgtctccgacgagggcgtgctcgacgctgatccgatggaagccatcgatcacgacatggacggcgccgaccgcgccgcctcggacgctgggccaatctccggcgccgagcagcagtggaagaagactaggcttatctccatgatggaagaggtttgcaagaggtaccggctgtactaccagcaggtccagacagtgatcaactcgttcgagaccgtggccgggttcagcaacgctgccccattcgcggcgatggcgctgagagccatggcgaagcacttcaagtgcctgaagagcatgatactgagccagctgcgcaacaccaaggtcgctgccggcaaggaggggctcagcaaggacatcgtcatgttcgggctcgctggcggcagcgcggctgccctccagagagctagcagcatggccgccttcggccagccgcacaacatctggcggccacagagagggctgccggagcgcgcagtgtctgtcctccgcgcttggctcttcgaacacttcctgcacccatatcctactgatggagacaagcaaatgcttgctaaacagacgggtttaacacggaaccaggtatcaaactggtttattaatgcaagggttcgtctttggaagccaatggtggaggaaatccacaacctcgagatgaggcaggtgcacaaacaccctgttctcgacaagggacagcacgtgttgcatcaccaaacccagcattcgtctgagagcagtggaaaaccctctgatccttccgactctcatctcggccaaagcagcagcctcactaggaaccacaacatccctgcgtcccagggttttgcagatgagctctccgagatgtcccactctattcagcaggggcaggtaacctttgcatacaatgggctgtcgacggcacaccacagcctcgcttcgtcgcagcaccaccagcaggcagggccaatgagtggcattggtggtgcggggaacggtggcgtctccctcacccttggcctccaccagaacaacagagtctgtattgccgagccactcccggagtccctccctcccaacctcgctcaccgttttgggctggaggaggtcagcgacccctacatgatgggctctttcggaaaccaggaccggcatttcggcaaggagatgggtggccatttggtgcatgactttgttggctga

SEQ ID NO: 231 - protein, 593 aa, Sorghum bicolor
MSSAAGGYGGGAGSGAEPHCHGHGHGDFMLHHHAQHIAAQQLYHVPQHSRREKLRFPPDDSPPHASASAPQQQHAGVAWPPPPPPPAFYSYASSSTSSYSPHSPTLAQAQLVVAHGLAPPPLSSQIPTQNFALSLSSSSSNPPPAPPPQQRRAHAAPSAPFGPFTGYAAVLGRSRFLGPAEKLLEEICDVGGAASHVDRSVSDEGVLDADPMEAIDHDMDGADRAASDAGPISGAEQQWKKTRLISMMEEVCKRYRLYYQQVQTVINSFETVAGFSNAAPFAAMALRAMAKHFKCLKSMILSQLRNTKVAAGKEGLSKDIVMFGLAGGSAAALQRASSMAAFGQPHNIWRPQRGLPERAVSVLRAWLFEHFLHPYPTDGDKQMLAKQTGLTRNQVSNWFINARVRLWKPMVEEIHNLEMRQVHKHPVLDKGQHVLHHQTQHSSESSGKPSDPSDSHLGQSSSLTRNHNIPASQGFADELSEMSHSIQQGQVTFAYNGLSTAHHSLASSQHHQQAGPMSGIGGAGNGGVSLTLGLHQNNRVCIAEPLPESLPPNLAHRFGLEEVSDPYMMGSFGNQDRHFGKEMGGHLVHDFVG

SEQ ID NO: 232 - DNA, 1713 bp, Oryza sativa
atgtcttcggcggcgggcggtggtggatacggggccggcggcggcgccgagcaccagcacctgttgctggggcaggcggcggggcagctctaccacgtgccgcagcacagccgccgcgagaagctgcggttcccgcccgacccggccgactcgcccccgcccactgcctggccggcgcccccacccttctactcctacgcgtcctcgtcgacgtcgtcctactcgccgcatagcccaacgccgctggcgcacgcgcagctcgtggcgcacgcgctacctgcaggcgccggggcccagatcccgagccagaacttcgcgctctcgctctcctcggcgtcctcgaaccctccgcccgcgccgcggaggcagctcgccgcgggggtagccacggggccgtacggcccgttcacgggctacgcggccgtcctcggccggtccaggttcctcggccccgcgcagaagctgctcgaggagatctgcgacgtgggcggacggcccccgcacctggaccggcgctccgacgagggcatgctcgacatggacgccatggacgtggttggggacgtggaccatgacatggacggcggtgaccgcgctaccgctgaggcggtcgctgtctccggcgccgagcagcagtggaggaagaccaggctcatctccctcatggaggacgtttgcaggcgatacaagcagtactaccagcagctgcaatctgtgatctcctcgtttgagactgttgcggggctgagcaacgccgccccctttgcttccatggctcttcggacaatgtcgaagcatttcaagtgtctcaaggaaatgataatgagccaattaaggaacacaagcaaggttgtcgccaatgatggtattggcaaagacgatatggctaactttgcgcttatgggtggtggagcaggcctcctgaggggaaacaatgtgaacgcattcggccagcctcacaacatttggaggcctcaaagagggcttcctgagcgtgcagtgtctgtgcttcgctcgtggctgttcgagcacttcttacatccgtatccaactgatagtgacaagcagatgctggctaaacagacaggcttaacaaggaaccaggtgtcaaattggtttatcaatgcaagggtgcggctctggaagcccatggtggaagaaatccacaacctggagatgcggcaggtgcagaagaacacatcggtggacaagaatcaacttggcatgcagcagattcagcactcgacggacagcagtgggaagctttctgacccttcaaactctcagcgtgggcaaagcagcggcatgacaagaaacctcagctctccggcatcacgccatatccaagacgagctctcccagatgccccacgacatgccaggccaggtgagctttgcttacaatgggctccccacacaccacggtcttgcgctgtcacacccccagcaagctgaagcagtcagcgccggcattggccttggcggcgtggctgccggcggtggcggcgtttccctcacactcggccttcaccagaacaacaggacttacattgccgagccacttccggccgcgctcccgctcaacctcccgcaccgttttgggctggaggacgtgagcgacgcctacgtgatggggtcattcggcggcggccaggaccgtcatttcaccaagggaataggtggccaccatttgctccatgactttgttggttga

SEQ ID NO: 233 - protein, 570 aa, Oryza sativa
MSSAAGGGGYGAGGGAEHQHLLLGQAAGQLYHVPQHSRREKLRFPPDPADSPPPTAWPAPPPFYSYASSSTSSYSPHSPTPLAHAQLVAHALPAGAGAQIPSQNFALSLSSASSNPPPAPRRQLAAGVATGPYGPFTGYAAVLGRSRFLGPAQKLLEEICDVGGRPPHLDRRSDEGMLDMDAMDVVGDVDHDMDGGDRATAEAVAVSGAEQQWRKTRLISLMEDVCRRYKQYYQQLQSVISSFETVAGLSNAAPFASMALRTMSKHFKCLKEMIMSQLRNTSKVVANDGIGKDDMANFALMGGGAGLLRGNNVNAFGQPHNIWRPQRGLPERAVSVLRSWLFEHFLHPYPTDSDKQMLAKQTGLTRNQVSNWFINARVRLWKPMVEEIHNLEMRQVQKNTSVDKNQLGMQQIQHSTDSSGKLSDPSNSQRGQSSGMTRNLSSPASRHIQDELSQMPHDMPGQVSFAYNGLPTHHGLALSHPQQAEAVSAGIGLGGVAAGGGGVSLTLGLHQNNRTYIAEPLPAALPLNLPHRFGLEDVSDAYVMGSFGGGQDRHFTKGIGGHHLLHDFVG

SEQ ID NO: 234 - DNA, 1755 bp, Arabidopsis thaliana
atggatatgataaaaccagattttcaacaaatccgaagagataagtttagagttgagcaaatgaatgattttcccaacacttggactcagcagcagcatcagaacatcagaattcccaacaaccttgatttgattggtatcttacagaaccagatttccgtaccggttcaaaccgatttgtatcaagattctgccgcaacctttatgaacatgcctcagtcgatacatagagacccacaaggccctagtaattggagaatcagtgatttgtcacaacctagtaccgtgaatcacggatatgatcaggctggtattaggccaaacaacgttgcagatttgttgtccgatcatttcagttctcgaaaccaaatattggaccgtcctctttatgtcggccgggactctattcctcagtctagcatgattaggagaagtgaagtttcttgtctagacgataatcaaaagggttgtgtaacggtggcttgttcgggtactggtaatgagattttaaggagcagttatgatcaaggttcttcttctggaagttaccgaggagaattttcgtttctcccaagtttggagaatcaatcagttgcgcacaaagcaagcaactggaaccacggaccagtgaatgttactgccacttctcatactaatagtaagaaaggctttccactctcacttttgtctgatatccctccatctagagacgttggaaatgcagctgttttgtcaacaatgaatattcacggcccactcgggcctttcacgggatatgcatcgatactgaagagttcgaggttcttggagccggctcagaaaatgttagaagggttttgtatctcttatgcttcaaagattattagtagaagtgaatctacttccatggaggatgatgatgatgatgatgataacttgtcagggtttagtagttcttctgagccattagaacccaagaatagactaaagaaagcaaaacttctctttctgcaagaagaggtttgcaagtggtacaaactatataatcatcagttgcaaacagttatgtcttccttcaatacagtggctggtctaaacaccgcaacaccgtatatctcgttggctctcaaacggacttcacgaagtttcaaggcccttagaaccgcaatagctgaacatgtgaagcaaatctcaagtcactcatcaaacggtaacaacaacaaccgattccaaaagaggcaaagatctttgattggtaacaatgtcgggtttgaatctcaacaacaacatatctggaggcctcaaaggggattgcccgaacgtgcagtggctgctcttagagcatggctctttgaccattttcttcatccgtaccccactgattctgataagcagatgctagccactcaaactggtctctctcgtaaccaggtatcaaattggttcataaacgcccgtgtgcgattatggaaacctatggtggaagaaatacacacacttgagaccaaagcaattaaaaatgcagatactagtcacaacattgagccatcaaatagaccgaatactgttagcagtccgagccatgaacaaacgctaacgggcctctccgggacaaaacggtcgaggttagagtacatggacatggtggggttcaatagagggaacgtgtcactcacgttagagcttaggcgtggtgtggacaatgttatccaaacgcagactcaggatcatcagtttggaactggaagccaaatgtttcatgactttgtgggttga

SEQ ID NO: 235 - protein, 584 aa, Arabidopsis thaliana
MDMIKPDFQQIRRDKFRVEQMNDFPNTWTQQQHQNIRIPNNLDLIGILQNQISVPVQTDLYQDSAATFMNMPQSIHRDPQGPSNWRISDLSQPSTVNHGYDQAGIRPNNVADLLSDHFSSRNQILDRPLYVGRDSIPQSSMIRRSEVSCLDDNQKGCVTVACSGTGNEILRSSYDQGSSSGSYRGEFSFLPSLENQSVAHKASNWNHGPVNVTATSHTNSKKGFPLSLLSDIPPSRDVGNAAVLSTMNIHGPLGPFTGYASILKSSRFLEPAQKMLEGFCISYASKIISRSESTSMEDDDDDDDNLSGFSSSSEPLEPKNRLKKAKLLFLQEEVCKWYKLYNHQLQTVMSSFNTVAGLNTATPYISLALKRTSRSFKALRTAIAEHVKQISSHSSNGNNNNRFQKRQRSLIGNNVGFESQQQHIWRPQRGLPERAVAALRAWLFDHFLHPYPTDSDKQMLATQTGLSRNQVSNWFINARVRLWKPMVEEIHTLETKAIKNADTSHNIEPSNRPNTVSSPSHEQTLTGLSGTKRSRLEYMDMVGFNRGNVSLTLELRRGVDNVIQTQTQDHQFGTGSQMFHDFVG

SEQ ID NO: 236 - DNA, 1497 bp, Vitis vinifera
atggcggacagtcatcaacccttcaggctccctcagcaaagtaaaagagaaaatccccgcctctttcttcaaaacaaccacccacagcttttctccaccttccaacatgccccagttcaccagcttcattgccctgatcagaacccaaaccctgcaggttttgttaacagcgaaggagtgcatgtggttgggccctcctctgcgtctttttctttccctagttgcggtgaccattctctctcctccattcacaacgctaaagacttggaccaccgtttctcctttggcgctgacgctgtgtctttatctctggctcctcaccatcgccaccaacggtgtgctcctctggagctgaatgcgaagagatacgacgtcgtttccgttcgaggaggaactccgaagccgaacaacgaattgagaagttcggttccgcttggtcctttcacaggctacgcatcgatcttgaagcgatccagctttttgagccctgcgcagcagcttttagacgatttttgtggcgtaggccgtggagtttccgattcggcgtcatttgatcctccgttggaaggaagtggaaccgctgaagatccgatcggttgcagccatggcagcgagcatttctggaagagctccaggctcgcaccgatgctcgacgaggtttacaggagatataagctttactgtcagcagatgcattctgtagttgcatcgtttgaaactgttgctgggcttcaaaatgctgctccatacatatcttttgcgttcaaagccatgtcaaatcatttcaggtacttgaagaatgcaattttggatcaaattcagtttacaggcaaagctcttgtaggccataatattggaaaagacgaaactccaagagtttggacagctgaccaggggtttcatagccaaaaagcagttcagagctcaatgtttcttcaacatcctatttggcggtcccaaagaggacttccagatcatgcggtagctgtactcagggcatggttgtttgaacactttctacatccttatcctactgacttggagaagcaaattttggcccaacgaacaagcctatcaagaaatcaggtttccaactggttcatcaatgcaagagttagactatggaagccaatggtagaagaaatactcacgcttgagacaaagcaagctcaaatggcagcagagggagaggctaacaagccaactgacccccttccttcagcaaatccactgcctctcaggaaaccctttcaaaacacacccacccaaaagatggaagatactcagtctaaacgaagtagaaataaactctcctatatgttcgaacaaagagatgaacaaacgaactttccttacaataatttctcaagcaattaccaaatgggtgttagtggaattgagaaaagtgcaagcaaaggcatatctttagcattgggtctccaccaaaataacagaattgagtcatctacgagcttttttcagcctggaaacaaatag

SEQ ID NO: 237 - protein, 498 aa, Vitis vinifera
MADSHQPFRLPQQSKRENPRLFLQNNHPQLFSTFQHAPVHQLHCPDQNPNPAGFVNSEGVHVVGPSSASFSFPSCGDHSLSSIHNAKDLDHRFSFGADAVSLSLAPHHRHQRCAPLELNAKRYDVVSVRGGTPKPNNELRSSVPLGPFTGYASILKRSSFLSPAQQLLDDFCGVGRGVSDSASFDPPLEGSGTAEDPIGCSHGSEHFWKSSRLAPMLDEVYRRYKLYCQQMHSVVASFETVAGLQNAAPYISFAFKAMSNHFRYLKNAILDQIQFTGKALVGHNIGKDETPRVWTADQGFHSQKAVQSSMFLQHPIWRSQRGLPDHAVAVLRAWLFEHFLHPYPTDLEKQILAQRTSLSRNQVSNWFINARVRLWKPMVEEILTLETKQAQMAAEGEANKPTDPLPSANPLPLRKPFQNTPTQKMEDTQSKRSRNKLSYMFEQRDEQTNFPYNNFSSNYQMGVSGIEKSASKGISLALGLHQNNRIESSTSFFQPGNK

SEQ ID NO: 238 - DNA, 1698 bp, Vitis vinifera
atggcggatggttttgaaccctaccacgtaccacagcagagcagaagggataagcttagagttgtggctcagaaccactcgggctgtgtggaggcagctactaatcttcacggctgcgccggtttgctccctctctacgatccctcactgttgccttccgatttgctaacttgcgccagcgccagcgcccatgagtttcagcaccatagccacccactttcaggctctgctgaggcttgtaaggcaaacccaggttgtgttgttaaagaagaaggcgtgaatttgatgggttatgttgattttgatcagtccttcaatggtggtgagatggtggtgttcaagccggagcccttatcattgacccatcatgagtacgggtctgcaatttttagcgataaggttactggtggctatatggttccgggcattgttggtggtagtggttccacctctaatgatgtatcgaggagttccgtccctctcgggccttttacaggctatgcttcaattttgaagggatcgaggttcctgaaacctgcacagcagttgttggaggagttctgcgacgtgggctgcggactttacgccgaaagagtctcagcggattcgtcgatgatggatcctccaatggagagtctgagtggaactggaattgttgatgatccgctcagttgtggagatgggggggagcaccggagaaaaaagtcgaggctaatttcgatgctagacgaggtttacaggaggtacaagcactactatcaacaaatgcaggcagttgtagcatcatttgaatcggttgctggtctcggcaatgcggctccctatgccgacttggctctgaaagctatgtctaaacacttcaggtgtttgaagaatgccattaccgaccagcttcagttcacaaacaaagcccatggacaaataagtcatggaaaagatgaaagtccaaggtttgggaacactgatagaggcctttatggtcaaagacccatgcacagctcaggatttcttgaacatcaacctgtttggcgaccccaaaggggacttcctgagcgagctgtaactgtactcagggcatggttgtttgaacacttccttcacccttatcctactgatacagacaagctaatgttggctaagcagactggtctctcccggaaccaggtttccaactggttcatcaatgcaagagtaagactttggaagccaatggtggaagagatacacacgctggagacacgacaagctcaaaaatcttcccagagagaggagcgaagtgccgacaggcagagtgatcatttaccttcagcaaactcacttgtgtttgaaaatccatccacctctgctcaaagagttcaagacgccccatcaaaacgtaccagaaatgagctttctgaggtacacgtgggtagtgaggagccaatgaatttatcttacaataacttgtcggcccatccgcatgtgggagttggtgtgagcactgcaggtggaagcagtaatgtttccctgacactgggtcttcaccagaataatgggattggtttatcagagtcctttcctattaatgcagctcaacgttttgggcttggccttgatgcaaatagcgagggatatgttataggtggttttgaagcacaaaatcggcattttggaagggatgttattggagggcaacttttacatgattttgttggctga

SEQ ID NO: 239 - protein, 565 aa, Vitis vinifera
MADGFEPYHVPQQSRRDKLRVVAQNHSGCVEAATNLHGCAGLLPLYDPSLLPSDLLTCASASAHEFQHHSHPLSGSAEACKANPGCVVKEEGVNLMGYVDFDQSFNGGEMVVFKPEPLSLTHHEYGSAIFSDKVTGGYMVPGIVGGSGSTSNDVSRSSVPLGPFTGYASILKGSRFLKPAQQLLEEFCDVGCGLYAERVSADSSMMDPPMESLSGTGIVDDPLSCGDGGEHRRKKSRLISMLDEVYRRYKHYYQQMQAVVASFESVAGLGNAAPYADLALKAMSKHFRCLKNAITDQLQFTNKAHGQISHGKDESPRFGNTDRGLYGQRPMHSSGFLEHQPVWRPQRGLPERAVTVLRAWLFEHFLHPYPTDTDKLMLAKQTGLSRNQVSNWFINARVRLWKPMVEEIHTLETRQAQKSSQREERSADRQSDHLPSANSLVFENPSTSAQRVQDAPSKRTRNELSEVHVGSEEPMNLSYNNLSAHPHVGVGVSTAGGSSNVSLTLGLHQNNGIGLSESFPINAAQRFGLGLDANSEGYVIGGFEAQNRHFGRDVIGGQLLHDFVG

SEQ ID NO: 240 - DNA, 2436 bp, Vitis vinifera
atggagatgaggaactttagacctgaatcgcatgtagcacagcaaagccggcgtgataagcttagagttcaacatcaaagttcaaccccagctcaccatttggaggagttccctaacagtttggaacaattatcggtccatccagaactaaacccagatcttattcaagttcggaatgttaggaacggcaatgtgctttatgatcctattgtgctctcctcggaaatgctcaatttttcatcgaattctcatgtgtttttgggtagcaaggatgcaatggtggggcaagattcgaatgcagtctctcaggatgcttcattccccaatttgtctcacccaatttcatctaaagcagctggtgacccacaaaactgtgacaattggaaaggccttggtacacagcaaagctgtgattggattgtgaattatgctaatggaacggtggctagtgaaagcaatcaaaaccctatgtatgtcggggaagtcttgtcagccagctctatgaaggtaaacaacatttctgcatcttcactcgatttgaagcctaattacagtggatatcaggatgtgcagtcatcgataaccaatccatccagtgaaatttctagtcaagatagccagaagcattatggtgaaatccatttcaattctcctcaactctaccgaaacacgctccaagaggttgttacttcagctgcagttggaacccaggggctagaaatggcatcctttgcgcatcagaacattagggacactggccgtgattcatgggaagatggtgggaatgaacttgttcttcttccaaactttggaaatcagtctagtgctctccgtcttgattcttctgttgcttggatgactaggccagtagagggttgccatcagtggagtggtggtgatttgggtgttcttgcaaacaagagtcttggagacttgagtaccattgcaagtgattctaacgcacaaggtctgtcactttccctttcatcacatccttcatccaaaatacaggtagctcagtttggggagagatatgagtcgaaggatctacgttctggaactgcagctttcagttgcccacaagatttgaaagttatgagctctggttatttatgttcggattcaaagccacctgttagtggtaaagggtatggaaattcccttcacgacatagtggggacttctacttacactcataggagtgctggccctcttgggccattcactgggtatgcaacaattttaaagagttcaaaatttttgaagccagcacaacaggtcctggatgaattttgtaaagcagcaagtcccaaactggtgaaaacatgtgaggtaactcggaggacatctggagatggtggcaattcagctgtctcgtcctccacattttatgattcaaatgaaattagtgaagggggagttaagagcagctcctgtgaatcgtataggcctgactaccaacaaaagaaggcaaagctcttgtttatgcaggaggaggtttgcagaaggtacaagcaatatcatcaacagatgcaaatggtggtttcatcctttgaaactgtagcaggcctcagtgctgcgaccccctacattgccctggctctgaaaacagtctcgaggcactttcggttcctgaagaatgccatatcagaccagcttaggcacataaggaaagccttgggggaggattttgcaggggatgcaagttcaccaaggttaaactttccgaaacacaaacctggtggggctaacctgggtttccttgaaccccaacaacacgtctggaggccccaacgaggcctaccagaaagggcggtggctattcttagagcttggctgtttgagcatttccttcacccgtatccaacggacacagataaacatatgctagccactcaaaccggtctctctcgaaatcaggtatcaaactggttcataaatgcccgagttcgggtatggaagcccatggttgaagaagtacacatgcttgaaaccaaaggtttagcagaaagggatcaaaattcaggcaaaaaagattggaagtccattggtgaaggtgtcagccaacgggatggcaatcaaccttcaaacaagcctagtgtcaatgcaatgtctgatgagcaattggaatgcagggggatgtgtccctcagcaggcaccggagatgaattgggtgctgagcagtggaatcaagagaagcgatcaagagtggagtgccaaattcctggaagcatggacgggtcattgatgggttttgttccgtaccagcggagcggtgtcgagattgggggacttggagcagtgtcacttacattgggtctcaggcatagtgtggaaactgcacagcaacagcaacatcaacaacaattacaacagcaggaggatcaacttagacggcaatttggaggtcagatgattcatgattttgtgggttga

SEQ ID NO: 241 - protein, 811 aa, Vitis vinifera
MEMRNFRPESHVAQQSRRDKLRVQHQSSTPAHHLEEFPNSLEQLSVHPELNPDLIQVRNVRNGNVLYDPIVLSSEMLNFSSNSHVFLGSKDAMVGQDSNAVSQDASFPNLSHPISSKAAGDPQNCDNWKGLGTQQSCDWIVNYANGTVASESNQNPMYVGEVLSASSMKVNNISASSLDLKPNYSGYQDVQSSITNPSSEISSQDSQKHYGEIHFNSPQLYRNTLQEVVTSAAVGTQGLEMASFAHQNIRDTGRDSWEDGGNELVLLPNFGNQSSALRLDSSVAWMTRPVEGCHQWSGGDLGVLANKSLGDLSTIASDSNAQGLSLSLSSHPSSKIQVAQFGERYESKDLRSGTAAFSCPQDLKVMSSGYLCSDSKPPVSGKGYGNSLHDIVGTSTYTHRSAGPLGPFTGYATILKSSKFLKPAQQVLDEFCKAASPKLVKTCEVTRRTSGDGGNSAVSSSTFYDSNEISEGGVKSSSCESYRPDYQQKKAKLLFMQEEVCRRYKQYHQQMQMVVSSFETVAGLSAATPYIALALKTVSRHFRFLKNAISDQLRHIRKALGEDFAGDASSPRLNFPKHKPGGANLGFLEPQQHVWRPQRGLPERAVAILRAWLFEHFLHPYPTDTDKHMLATQTGLSRNQVSNWFINARVRVWKPMVEEVHMLETKGLAERDQNSGKKDWKSIGEGVSQRDGNQPSNKPSVNAMSDEQLECRGMCPSAGTGDELGAEQWNQEKRSRVECQIPGSMDGSLMGFVPYQRSGVEIGGLGAVSLTLGLRHSVETAQQQQHQQQLQQQEDQLRRQFGGQMIHDFVG

SEQ ID NO: 242 - DNA, 1080 bp, Zea mays
atggtcatggcgaagcagcaccatgacaaggggttgccgaagcaagctcgcaatgagcccgcgccgttccggctcgagcagtgttgccgctgcgacgatgcccaccgtcaggccgacgacgagtccatggatgctgctgggtctgctggcccgctgcacctgactctcggcccgctcggctcggccgccggcccccgctgctcgtgcggtgtcgcgccggcgccggcgccggcgctggcggcgcccgcaacggtggccgtcctccgcgggtcccggtacatgcggccggcgcaggagctgctgggcgaggttgtgcgcgtggccgacctggcggctgccgacgacgaagacgaggaccaggcgacggagcggctcgagggcggcggtcaccgggcagcgcgtcgggcggccgggaaggccgggaacgacggcgacggcgtccaggccaagctcctctacctgctcagcgagctggagagcaggcgggagcgctacttcggcgagctggagcgcgtggtgtcgtcgttcgagccggcgctgggcggcggcgcggcggcggcctacacgaccctgatggcgcgggccatgggccgccacttcggcaacctgcgccgcgccatactgcgcaggctcaggctccaagccgccgccgcggcgaggaggtctctgcggcgcggcggcgaggaccaggacgacgacgacgacgacgacggcgacagcgacggcgaggtgaccgaggagctggtggacaggttggctcggcggacgaagctggccgcggcggcgcgggcggagcaagcgtggcggccgctgcgtggcctgccggatggctccgtggccgtgctccgggcgtggctcttcgaccatttcctccacccgtaccccaacgacggcgagaagctgaggctggcggtgaccaccggcttgagcaggcgccagatatccaactggttcatcaacgcgcgcgtgcggctgtggaagcccatgatcgaggagatgtacaaggacgagttctccgacggttccgccgtctccagctacgacgacgccagcgccagcggcgcctcctcatcctcctga

SEQ ID NO: 243 - protein, 576 aa, Zea mays
MSSAAGGGYGAAGGAEHQHLLLGQASGQLYHVPQHSRREKLRFPPDPADSPPPTAWPAPPPFYSYASSSTSSYSPHSPTLAHTQLVAHALPAGAGAQIPSQNFALSLSSASSNPPPAPRRQLAAGVAAGPYGPFTGYAAVLGRSRFLGPAQKLLEEICDVGGRPPHLDRRSDDEGMLDMDAAGGVDHEMDGGDCATAEAVAVSGAEQQWRKTRLISLMDDVCRRYKQYYQQLQSVISSFETVAGLSNAAPFAFMALRTMSKHFKCLKGMVMSQLRNTSKVIANHGIIAKDDMANFALMGGGAGLLRGNSVNAFSQPHNIWRPQRGLPERAVSVLRSWLFEHFLHPYPTDSDKQMLAKQTGLTRNQVSNWFINARVRLWKPMVEEIHNLEMRQLHKTTSVDQNQLGMQQQNHHSSDGSGRPSSDPSNSQRGQSSGMTRNLSSRAPRHIQDDELSQMPHDMAGQVSFAYSGLPPAHHGLALSHHHHPQQAQAEAVGVGGVAASSGGGVSLTLGLHQNNNNNRAYIAEPLPAALPLSLPHRFGLEDVSDAYVMGPFGGQDRHFSKGIGGGHNLLHDFVG

SEQ ID NO: 244 - DNA, 1731 bp, Zea mays
atgtcctcggcggcgggcggtggatacggggctgcgggcggcgccgagcaccagcacctgttgctggggcaggcctcggggcagctctaccacgtgccgcagcacagccgccgcgagaagctgcggttcccgcccgacccggccgactcgcccccgcccactgcctggccggcgcctccacccttctactcctacgcgtcctcgtcgacgtcgtcctactcgccgcatagcccaacgctggcgcacacgcagctagtggcgcacgcgctacctgccggcgccggggcccaaatcccgagccagaactttgcgctctcgctctcttcggcgtcctcgaaccctccgcccgcgccgcggaggcagctcgccgcgggggtagccgctgggccgtacggcccgttcacgggctacgcggccgtcctcgggcggtccaggttcctgggccccgcgcagaagctactcgaggagatctgcgacgtgggcggacggcccccgcacctggaccggcgctccgacgacgagggtatgctcgacatggacgcggcggggggcgtggaccacgagatggacggcggtgactgcgctaccgctgaggcggtcgccgtctcgggcgccgagcagcagtggaggaagacaaggctcatctccctcatggatgacgtctgcaggcgatacaagcagtactaccagcagctgcaatccgtgatctcctcgttcgagactgttgcagggctgagcaacgcggcccccttcgctttcatggctcttcggacgatgtcgaagcacttcaagtgtctgaaggggatggtgatgagccagctacggaacacgagcaaggtcatcgccaaccatgggattattgccaaggacgatatggcgaacttcgcgctcatgggtggtggagcaggcctcctgaggggaaacagcgtgaacgcgttcagccagcctcacaacatttggaggcctcaaagagggcttcctgagcgtgcagtgtctgttcttcgctcatggctgtttgagcacttcttgcatccgtatccaactgatagtgacaagcagatgctggctaaacagacagggttaacaaggaaccaggtgtccaattggttcatcaacgcaagggtgcgtctctggaagccgatggtggaagagatccacaacctggagatgcggcagctgcacaagaccacatcggtggaccagaatcaactcggcatgcagcagcagaaccaccactcgtcggacggcagcgggaggccttcctccgacccttcgaactcccagcggggccaaagcagcggcatgacaagaaacctcagctctcgggcaccacgccacatccaggacgacgagctctcccagatgccccacgacatggcaggacaggtgagctttgcgtacagtgggctcccccccgcgcaccacggtctcgcgctgtcacaccaccaccacccccagcaagcgcaagctgaggcggttggtgttggcggcgtggccgccagcagcggcggcggcgtttccctcacgcttggccttcaccagaacaacaacaacaacagggcatatatcgccgagcccctcccggccgcgctcccgctcagcctcccgcaccggttcgggctggaggacgtgagcgacgcctacgtgatggggccgttcggcggccaggaccgccatttcagcaaggggatcggtggtgggcacaacttgctccatgactttgtcggttga

SEQ ID NO: 245 - protein, 359 aa, Zea mays
MVMAKQHHDKGLPKQARNEPAPFRLEQCCRCDDAHRQADDESMDAAGSAGPLHLTLGPLGSAAGPRCSCGVAPAPAPALAAPATVAVLRGSRYMRPAQELLGEVVRVADLAAADDEDEDQATERLEGGGHRAARRAAGKAGNDGDGVQAKLLYLLSELESRRERYFGELERVVSSFEPALGGGAAAAYTTLMARAMGRHFGNLRRAILRRLRLQAAAAARRSLRRGGEDQDDDDDDDGDSDGEVTEELVDRLARRTKLAAAARAEQAWRPLRGLPDGSVAVLRAWLFDHFLHPYPNDGEKLRLAVTTGLSRRQISNWFINARVRLWKPMIEEMYKDEFSDGSAVSSYDDASASGASSSS

SEQ ID NO: 246 - DNA, 53 bp, Artificial sequence
  primer 1
ggggacaagtttgtacaaaaaagcaggcttaaacaatggctgaggagggtttt

SEQ ID NO: 247 - DNA, 52 bp, Artificial sequence
  primer 2
ggggaccactttgtacaagaaagctgggtttgcttagttagtggattgaaga

SEQ ID NO: 248 - DNA, 2194 bp, Oryza sativa; identical to SEQ ID NO: 61

SEQ ID NO: 249 - protein, 6 aa, Artificial sequence
  Conserved domain
GPFTGY

SEQ ID NO: 250 - protein, 9 aa, Artificial sequence
  Conserved domain
SNWFINARV

SEQ ID NO: 251 - protein, 4 aa, Artificial sequence
  Conserved domain
RGLP

SEQ ID NO: 252 - protein, 7 aa, Artificial sequence
  Conserved domain
HFLHPYP

The invention claimed is:

1. A method for enhancing and/or increasing a yield-related trait in a cereal plant relative to a control plant, comprising: increasing expression in a cereal plant of a nucleic acid encoding an Ornithine Decarboxylase polypeptide having at least 90% sequence identity to the amino acid sequence of SEQ ID NO: 2, and selecting for a cereal plant having an enhanced yield-related trait selected from the group consisting of early vigor, aboveground biomass, number of filled seeds, total number of seeds, and total seed yield; relative to a control plant.

2. The method of claim 1, wherein said expression is increased by introducing and expressing in said plant a nucleic acid encoding said Ornithine Decarboxylase polypeptide.

3. The method of claim 1, wherein said nucleic acid is capable of hybridizing with a nucleic acid comprising the nucleotide sequence of SEQ ID NO: 1 under conditions comprising hybridization at 65° C. in 1×saline sodium citrate (SSC) or at 42° C. in 1×SSC and 50% formamide, followed by washing at 65° C. in 0.3×SSC.

4. The method of claim 1, wherein said nucleic acid encodes an orthologue or paralogue of a polypeptide comprising the amino acid sequence of SEQ ID NO: 2.

5. The method of claim 1, wherein said plant has increased shoot biomass relative to a control plant.

6. The method of claim 1, wherein said enhanced yield-related trait is obtained under cultivation conditions of nitrogen deficiency.

7. The method of claim 2, wherein said nucleic acid is operably linked to a constitutive promoter.

8. The method of claim 1, wherein said nucleic acid is of plant origin.

9. A cereal plant or part thereof, or seeds or progeny of said cereal plant, wherein said plant or part thereof, or seeds or progeny, comprises a recombinant nucleic acid encoding an Ornithine Decarboxylase polypeptide having at least 90% sequence identity to SEQ ID NO: 2.

10. A method for the production of a transgenic cereal plant having an enhanced yield-related trait relative to a control plant, comprising:

(i) introducing and expressing in a cereal plant a nucleic acid encoding an Ornithine Decarboxylase polypeptide having at least 90% sequence identity to the amino acid sequence of SEQ ID NO: 2;

(ii) cultivating the cereal plant under conditions promoting plant growth and development; and (iii) selecting for a cereal plant having an enhanced yield-related trait relative to a control plant;

wherein said yield-related trait is selected from the group consisting of early vigor, aboveground biomass, number of filled seeds, total number of seeds, and total seed yield.

11. The method of claim 2, wherein said nucleic acid is operably linked to a GOS2 promoter or a GOS2 promoter from rice.

12. The method of claim 1, wherein said nucleic acid is from a dicotyledonous plant, from a plant of the family Solanaceae, or from *Nicotiana tabacum.*

13. The method of claim 1, wherein said plant has an increase of at least 5% for aboveground biomass, early vigor, number of filled seeds, total number of seeds, and total seed yield relative to the control plant.

14. A method for increasing aboveground biomass and/or seed yield in a cereal plant relative to a control plant, comprising:

(a) increasing expression in a cereal plant of a nucleic acid encoding an Ornithine Decarboxylase polypeptide having at least 90% sequence identity to the amino acid sequence of SEQ ID NO: 2 and (b) selecting for a cereal plant having increased aboveground biomass and/or one or more seed-related parameters selected from the group consisting of total seed yield, number of filled seeds, and total number of seeds per plant relative to a control plant: by measuring aboveground biomass and/or said one or more seed-related parameters of said cereal plant and said control plant.

15. The method of claim 14, wherein said plant having increased aboveground biomass and/or seed yield further exhibits increased early vigor relative to the control plant.

16. The method of claim 14, wherein said plant has an increase of at least 5% for aboveground biomass, early vigor, number of filled seeds, total number of seeds, and total seed yield relative to the control plant.

17. The method of claim 1, wherein said nucleic acid encodes an Ornithine Decarboxylase polypeptide having 95% sequence identity to the amino acid sequence of SEQ ID NO: 2.

18. The method of claim 1, wherein said plant is rice, maize, wheat, barley, millet, rye, *triticale, sorghum*, or oats.

19. The method of claim 14, wherein said nucleic acid encodes an Ornithine Decarboxylase polypeptide having 95% sequence identity to the amino acid sequence of SEQ ID NO: 2.

20. The method of claim 14, wherein said plant is rice, maize, wheat, barley, millet, rye, *triticale, sorghum*, or oats.

21. The method of claim 14, wherein said nucleic acid is operably linked to a GOS2 promoter or a GOS2 promoter from rice.

* * * * *